United States Patent 7,745,391 (HUMAN THROMBOSPONDIN POLYPEPTIDE) - sequence listing, part 32

SEQ ID NO: 73352 - DNA, 401 bp, Homo sapiens
tcggacccatttccttactgcctcttgccctagagtgatcctgagaaccactgctatttatgtcttagtgctgtattgccttgtatttccttctgagttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctacgagtggaaggatttccttactgcctcttgcctgccaggggtttttcgggagcccctctctgttccactctgattccttttgtttctttgctgaccattcactctctgtgtctgttgttggatccaaatacgagtgtttttctttcaaattgtggt

SEQ ID NO: 73353 - DNA, 5956 bp, Homo sapiens
cgcggccgagtcgcggaggcgcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagcagagcccatccaggacactccacactgccaggacacacccaggcggcccgcccttgcctgtctgcacctggggagaagccggcgctcctgctccctcctggggaggctgacgggtgtggccacccgctgtcacaatggcacactgccactgtcccttggcacgcacacagccacagccacacgtgtgacctgctgggccgtggttctggagtctacctgcggatgagcctgcggcagtcctggggaaacttttccagagcctgttagcccgtggctacggtcaggctctggccagggcagagggctgcccagggccaggctcacagtacaggagggtggcgaggcccctccctcactggcacgcatgagcaccacccgcctccccgactcccaagagtgcacctgctgcggccacagctccgtggaaggactccccctacctgagcagagcagaagccccagggcggagctcccagccagcatggtccgctgagggctggggggcggtctccgaggcccctcaacagagaagcctccacctgaggatggggaggacctggcaggcagcttccacggcagggctgggaagttcagtgcctggaaataaagagcaaggaaaaatggacctcaggcttcgtggctcctttaggatgtcacctcaccggcctggggaaggcggggggtgcccaagcccagccctgtgcccccgctgaacctggctggaccgcgtgtgaaaggcagaactaacgtgcggaaacatttgaaaacaactctgaatgtgcggttcggaatcacccgatcacagacgagcggtcaccggaatcgcccggtcacagacgagcagtcatcggactcacccgatcacagacgagcggtcaccggaatcgcccgatcacagacgagcggccaccggaatcgcccaatcacagacaagcagtcatcggaatcacccgatcacagacgagcagtcatcggactcacccgatcacagacgagcggtcaccagactcgcccgatcacagacgagcagtcatcggaatcacccgatcacagacgagcagtcatcggactcacccgatcacagacgagcggtcaccagaatcgcccgatcacagacgagcagtcatcggaatcacccgatcacagacgagtggccaccggaatcacccgataacagcccatcacaactccaaagcccttgtgttgaaaaggccgaggacgagtggtcaccaaacagggtggctccccaggtcccgaagcctgagacccggaaggccctggcacccttacaccctcggactcctgccctcctcggcctccctggccccagcgcggctccaccctgggctgcgtctcctggtcacaggctgcgtttctcctttctgtccgtgggcagcccagtccccacagtcacggccaagccacgcagaacgaacatgactccagaggacctcgccctggagctgagcctggcgccgggtcaggacggagggaagggcgggttggggtccgcgggtcctcacaccgcacggcaggcacagaggctcgccaggccctgatccggtctgtggggacgagggacactgaggagaggtgctgggcaccaggacgctgcctcctggtccctggttggcctcagacaagcacggcctcgagaaaagagccaagcgcatcgggagcacaccagaaaccggccctgagcacgagaagagcctccgcccggcccgggcaccacccgacctcgcagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacgccctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcagttacaacttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgctgcggccgcctgcttttgtgaatggtgttttgttggcacagggcctgtcctgtgttttcacacaggcctgtggctcctgctgtacaagtggagtggggaggagttgagatggagatgccttggccctggacacttacctgtccctctactggcccagctcatctcctcctgtgggcaatcacgcgtgcactggccaccctcccaccccacagcacacaccacgaggggatggcacagggggaagatgaggctggaccgtgatgttatcaataggctagaacgtccttcaaacactgaacctgcatctttcctcctcttactactgaacactttgtgagctctggtggtccagggtgcagcgtttgtccctgggcatgtgatggggagtcctgggcacatcgagatgctttacttctttctttcgacctcttaaaaaactaaaccaagccaaaccacaaaggaaatctgcacaacttaagagaaacttgaaagggatcgtgtaactactagtttgtactaagtttttttcaagaaagggaaacaaatttatatatatatatatatatatatatgtgcaatatatttttacactgtgtgattaacattagggagtactgagtgcatcactttatcagtgtgacgggtgatgtccacgtcatggctgttctgactctgaaagccacttctgctgatgtctaaaccgcactacaaccggacgtccgcggggtggggtggccctgctgttcctcctgcaggtgagaggtgtggtgttgcctgttggacttgctgttgagcctggcttgcaaacctgtagtgaaacagctcgtgtctgtgtgcacactgctcctgtgtctgctgtcgttaacattgtgtgtcaagttggtaaagtgacaaataaaggtgttaaaacatggattt

SEQ ID NO: 73354 - DNA, 5425 bp, Homo sapiens
cgcggccgagtcgcggaggcgcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagcagagcccatccaggacactccacactgccaggacacacccaggcggcccgcccttgcctgtctgcacctggggagaagccggcgctcctgctccctcctggggaggctgacgggtgtggccacccgctgtcacaatggcacactgccactgtcccttggcacgcacacagccacagccacacgtgtgacctgctgggccgtggttctggagtctacctgcggatgagcctgcggcagtcctggggaaacttttccagagcctgttagcccgtggctacggtcaggctctggccagggcagagggctgcccagggccaggctcacagtacaggagggtggcgaggcccctccctcactggcacgcatgagcaccacccgcctccccgactcccaagagtgcacctgctgcggccacagctccgtggaaggactccccctacctgagcagagcagaagccccagggcggagctcccagccagcatggtccgctgagggctggggggcggtctccgaggcccctcaacagagaagcctccacctgaggatggggaggacctggcaggcagcttccacggcagggctgggaagttcagtgcctggaaataaagagcaaggaaaaatggacctcaggcttcgtggctcctttaggatgtcacctcaccggcctggggaaggcggggggtgcccaagcccagccctgtgcccccgctgaacctggctggaccgcgtgtgaaaggcagaactaacgtgcggaaacatttgaaaacaactctgaatgtgcggttcggaatcacccgatcacagacgagcggtcaccggaatcgcccggtcacagacgagcagtcatcggactcacccgatcacagacgagcggtcaccggaatcgcccgatcacagacgagcggccaccggaatcgcccaatcacagacaagcagtcatcggaatcacccgatcacagacgagcagtcatcggactcacccgatcacagacgagcggtcaccagactcgcccgatcacagacgagcagtcatcggaatcacccgatcacagacgagcagtcatcggactcacccgatcacagacgagcggtcaccagaatcgcccgatcacagacgagcagtcatcggaatcacccgatcacagacgagtggccaccggaatcacccgataacagcccatcacaactccaaagcccttgtgttgaaaaggccgaggacgagtggtcaccaaacagggtggctccccaggtcccgaagcctgagacccggaaggccctggcacccttacaccctcggactcctgccctcctcggcctccctggccccagcgcggctccaccctgggctgcgtctcctggtcacaggctgcgtttctcctttctgtccgtgggcagcccagtccccacagtcacggccaagccacgcagaacgaacatgactccagaggacctcgccctggagctgagcctggcgccgggtcaggacggagggaagggcgggttggggtccgcgggtcctcacaccgcacggcaggcacagaggctcgccaggccctgatccggtctgtggggacgagggacactgaggagaggtgctgggcaccaggacgctgcctcctggtccctggttggcctcagacaagcacggcctcgagaaaagagccaagcgcatcgggagcacaccagaaaccggccctgagcacgagaagagcctccgcccggcccgggcaccacccgacctcgcagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacgccctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcagttacaacttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgctgcggccgcctgcttttgtgaatggtgttttgttggcacagggcctgtcctgtgttttcacacaggcctgtggctcctgctgtacaagtggagtggggaggagttgagatggagatgccttggccctggacacttacctgtccctctactggcccagctcatctcctcctgtgggcaatcacgcgtgcactggccaccctcccaccccacagcacacaccacgaggggatggcacagggggaagatgaggctggaccgtgatgttatcaataggctagaacgtccttcaaacactgaacctgcatctttcctcctcttactactgaacacttggagcttgtgtcaggtgcacgtgtctggatggatggagctgccatgaatgtatta

SEQ ID NO: 73355 - DNA, 1922 bp, Homo sapiens
ctcggctctaccttgtctctcggctctaccttgtctctcggctctaccttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgctgcggccgcctgcttttgtgaatggtgttttgttggcacagggcctgtcctgtgttttcacacaggcctgtggctcctgctgtacaagtggagtggggaggagttgagatggagatgccttggccctggacacttacctgtccctctactggcccagctcatctcctcctgtgggcaatcacgcgtgcactggccaccctcccaccccacagcacacaccacgaggggatggcacagggggaagatgaggctggaccgtgatgttatcaataggctagaacgtccttcaaacactgaacctgcatctttcctcctcttactactgaacactttgtgagctctggtggtccagggtgcagcgtttgtccctgggcatgtgatggggagtcctgggcacatcgagatgctttacttctttctttcgacctcttaaaaaactaaaccaagccaaaccacaaaggaaatctgcacaacttaagagaaacttgaaagggatcgtgtaactactagtttgtactaagtttttttcaagaaagggaaacaaatttatatatatatatatatatatatatgtgcaatatatttttacactgtgtgattaacattagggagtactgagtgcatcactttatcagtgtgacgggtgatgtccacgtcatggctgttctgactctgaaagccacttctgctgatgtctaaaccgcactacaaccggacgtccgcggggtggggtggccctgctgttcctcctgcaggtgagaggtgtggtgttgcctgttggacttgctgttgagcctggcttgcaaacctgtagtgaaacagctcgtgtctgtgtgcacactgctcctgtgtctgctgtcgttaacattgtgtgtcaagttggtaaagtgacaaataaaggtgttaaaacatggattt

SEQ ID NO: 73356 - DNA, 1855 bp, Homo sapiens
cgcggccgagtcgcggaggcgcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagaggcaaggcgggggccgaagcgtttactttgaaaaaattagagtgttcaaagca

SEQ ID NO: 73357 - DNA, 686 bp, Homo sapiens
tcttcaacatggcgacgctcttggttccctacagaaaggggcggagcctggactggggggcaggctcagattcaggttaaattgtggattgagctcgcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatgacctgatgacatacatgtgaggtgtgctcagacatgctagcaag

SEQ ID NO: 73358 - DNA, 1408 bp, Homo sapiens
tcttcaacatggcgacgctcttggttccctacagaaaggggcggagcctggactggggggcaggctcagattcaggttaaattgtggattgagctcgcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73359 - DNA, 293 bp, Homo sapiens
  misc_feature (44)..(44): n is a, c, g, or t
  misc_feature (58)..(58): n is a, c, g, or t
ctcaaccatgtatgtcatcaagggtccatggggcaccagcaaanccaatcagcggcanacgtccagccagtcgttgtcgggtaagggtgatggtttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73360 - DNA, 383 bp, Homo sapiens
ctatacaattcgagctcggaccccattattgttattgagagcaaggctgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73361 - DNA, 1257 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73362 - DNA, 1280 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaaaaaaacaccacctctcacccacg

SEQ ID NO: 73363 - DNA, 2146 bp, Homo sapiens
  misc_feature (11)..(11): n is a, c, g, or t
  misc_feature (1549)..(1549): n is a, c, g, or t
  misc_feature (1629)..(1629): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaacaaaaaaaaaaaaaaaaacaaaaaaaaaaaaacgtgtggtgggccgcgcctgcgcacccttggaagaaagctcttccaagaacccattccgttggggcgcgcggcgggcccccggatgaggttaggggtggacacggtggtcccaccaagccgtggtcccaaggaagcacccgggcccatggaccatggcggctctggccttctctcacaactaaaaaaagcgccgcggtgggcacacgccgaccgcgtttcgtgaaccaattccagaagggaggtccgggaggccaatagncgggtcctcctaccaaaagcagggaggcccaaggcgggacgcccggaaattaaaattaagaccggcgcccgcgtgggganacatgacaacccaggtctaaaaaaaaataaaaccatcaccgccgacaagaaaagcaccacacacacagacgacaaagcatacaccgaatagcaacgcggcaagagacaaatccacaaccacactgcccccccgcgcacatacacccggcccctcggctaacacaccggggcgaccaaaccaaaccatgccccactaatgccgcgccaggcgtcaacgacgccaaacataggggccgggaacgcccacccacagacgatgggggggcaaccacacaaggcaaaatgctgcaaaaagccgcataaagcgacacagggcacaggagtcacatccaggaacagcgccacctgggcgcaccaaccttcgggcgaaacagccggcgcaaacagctagcgggatgttacactccgacacaggcaacgcgtcgcggctgccgcggacaaccggggcaacgtggaagcacacacagaacgcgaaccagcaacagggcacagcagcgaccacaacatcgagagaata

SEQ ID NO: 73364 - DNA, 1368 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73365 - DNA, 1194 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73366 - DNA, 1383 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73367 - DNA, 1177 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73368 - DNA, 1276 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73369 - DNA, 1622 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73370 - DNA, 1352 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73371 - DNA, 1698 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggtaacagccagggcccctctgtgtgtctgttactgtgcactcctgtggctgtggttgtattattctgtgtgcacttgtttttaatgtctgtctgtccttttcttctactctgtacaacataagccctagaaagaccggactttttgttgctgttgttcatttgtgtttatgcttcatgcctgggtccatactagggatctgataaattttattgaatgactgaataacactgagtagaagcatgcctacatatgcgtttgtcactagtatatatagggaggacaaaggcttgctggtcctcctgtagccagtgccctgttggtcccccaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73372 - DNA, 1801 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccggtaagccatggaagggtgaggccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggtaacagccagggcccctctgtgtgtctgttactgtgcactcctgtggctgtggttgtattattctgtgtgcacttgtttttaatgtctgtctgtccttttcttctactctgtacaacataagccctagaaagaccggactttttgttgctgttgttcatttgtgtttatgcttcatgcctgggtccatactagggatctgataaattttattgaatgactgaataacactgagtagaagcatgcctacatatgcgtttgtcactagtatatatagggaggacaaaggcttgctggtcctcctgtagccagtgccctgttggtcccccaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73373 - DNA, 1382 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtgccccagtaatgtgggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73374 - DNA, 1360 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccggtaagccatggaagggtgaggccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73375 - DNA, 1117 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccggaggagatcgggcagttggtgaagcagatgctggatgactttggaccacatcgctacattgccaacctgggccatgggctttatcctgacatggacccagaacatgtgggcgcctttgtggatgctgtgcattgaaacaaaccacgggggtaccggagttcgaaat

SEQ ID NO: 73376 - DNA, 1416 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73377 - DNA, 1747 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtgccccagtaatgtgggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73378 - DNA, 1625 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagctgagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73379 - DNA, 1960 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccggtaagccatggaagggtgaggccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggtaacagccagggcccctctgtgtgtctgttactgtgcactcctgtggctgtggttgtattattctgtgtgcacttgtttttaatgtctgtctgtccttttcttctactctgtacaacataagccctagaaagaccggactttttgttgctgttgttcatttgtgtttatgcttcatgcctgggtccatactagggatctgataaattttattgaatgactgaataacactgagtagaagcatgcctacatatgcgtttgtcactagtatatatagggaggacaaaggcttgctggtcctcctgtagccagtgccctgttggtcccccaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73380 - DNA, 1857 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggtaacagccagggcccctctgtgtgtctgttactgtgcactcctgtggctgtggttgtattattctgtgtgcacttgtttttaatgtctgtctgtccttttcttctactctgtacaacataagccctagaaagaccggactttttgttgctgttgttcatttgtgtttatgcttcatgcctgggtccatactagggatctgataaattttattgaatgactgaataacactgagtagaagcatgcctacatatgcgtttgtcactagtatatatagggaggacaaaggcttgctggtcctcctgtagccagtgccctgttggtcccccaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73381 - DNA, 1750 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtgccccagtaatgtgggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagctgagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73382 - DNA, 1519 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccggtaagccatggaagggtgaggccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73383 - DNA, 1095 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73384 - DNA, 1751 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagctgagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73385 - DNA, 1769 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtgccccagtaatgtgggacagggcagggactcggggcgcggggagatcactctggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagctgagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73386 - DNA, 1037 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggcattgcagctgtttgagtcccatgcagggcatcttggcccacagctcttcaacaagtttgcacttcgtgggcagcgctgcccacgaagtgctggtgtcaacatgcactccagtcacaggggggagaaagcccagcttcaccccgttaagcttgctcaggatcaacatgcaagccccaggctggctttgctgctggagagaagtctggccagtgggacagctctcagacctgccacgaccattgatctgagggccagcaggtcacccctgcctgccacctgccttgaggcaaccacatccacttcgtgggcagcgggtaccgagc

SEQ ID NO: 73387 - DNA, 1736 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagctgagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatgatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73388 - DNA, 744 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtaccccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73389 - DNA, 1024 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccaccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaagtttcggagttgaacctattgtgtagttttgtttgtgaaagattgtcccatatcctcagttcttcttagcctctgtctccttccctgggaccctctcatatcctcttatag

SEQ ID NO: 73390 - DNA, 720 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtaccgcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73391 - DNA, 789 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73392 - DNA, 1010 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccagtgccccagtaatgtgggacagggcagggactcggggcgcggggagatcactctggaagtatggtgagggggggggggggggcttcaagcaccat

SEQ ID NO: 73393 - DNA, 841 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73394 - DNA, 1055 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggcctccagcgtagcatactgacacctacccccacccccacctgatcgccagacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggaccccagtgccctgttggtcccccaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73395 - DNA, 544 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttggggtgagttctccagagcacgcggtgtggctagccgggcttctaatttgagtcttccaactcaggactctatccctctactcccctttccccaccctggagacctcccaacctgaactccgttagctgggatcctgaatcctaaaaccatggatttttgagatgttcatcccagggccttaattcaagggatgcctcaggatttccaaccaggatctctattctgggaccatcaactctgatccctctttatcccccagcctgggtatttctcagcccctgaaccagcccagtgacattcccgtttctgaggctcactagttcgaagacccccaaactatccttagtgggccttcattccctccccccagtccctctggttgcttcgagcttggaagagtagagactaagtggagggaagaggccccagggcgggcccttctggagtttg

SEQ ID NO: 73396 - DNA, 1141 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagacctgtctcctgtttcctacagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccagatcatctttgctaaggatgggcattttgccctggaggagctggcccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73397 - DNA, 1228 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcaggtgaggggtccacaaaagagggaaagatttatgccttcagtctgccacctagcaacctgtctcctgtttcctacagccactgcgtcgcttccctctggatgctgccatcattttctccgacatccttgttgtaccccaggtacccactcaaacctgatcctagaatataatccaaggacgccttgaaaatccttctatcagtccagtcaaggtttacaataagcacttatcctaactggatcgagggaaaaactaaggttgaaagaaatggagtttggcagagttttattctccttttccttcctcctggaatgagctgaacagaacctttcctcctggattccattttgggaacccagatgttttctccccctccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccaccaagctggctatgaggtggttgggcttgactggacagtggccccaaagaaagcccgggagtgtgtggggaagacggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73398 - DNA, 838 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccaggtgacattgcagggcaacctggacccctgtgccttgtatgcatctgaggaggagatcgggcagttggtgaagcagatgctggatgactttggaccacatcgctacattgccaacctgggccatgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73399 - DNA, 596 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccagagtttagggaaacccgggctgcccaggactttttcagcacgtgtcgctctcctgaggcctgctgtgaactgactctgcagccactgcgtcgcttccctctggatgctgccatcattttctccgacatccttgttgtaccccaggcactgggcatggaggtgaccatggtacctggcaaaggacccagcttcccagagccattaagagaagagcaggacctagaacgcctacgggatccagaagtggtagcctctgagctaggctatgtgttccaagccatcacccttacccgacaacgactggctggacgtgtgccgctgattggctttgctggtgccccatgacctgatgacatacatgtgaggtgtgctcagacatgctagcaag

SEQ ID NO: 73400 - DNA, 397 bp, Homo sapiens
  misc_feature (11)..(11): n is a, c, g, or t
tctgacgcccntttgcaaacacagccttgggcacacttgctacagcccacggggcagcagttacagacagctgaccatggaagcgaatgggttgggacctcagggttttccggagctgaagaatgacacattcctgcgagcagcctggggagaggaaacagactacactcccgtttggtgcatgcgccaggcaggccgttacttaccaggtgccccagtaatgtgggacaggtgggctttatcctgacatggacccagaacatgtgggcgcctttgtggatgctgtgcataaacactcacgtctgcttcgacagaactgagtgtatacctttaccctcaagtaccactaacacagatgattgatcgtttccaggacaataaaagtttcggagttgaa

SEQ ID NO: 73401 - DNA, 342 bp, Homo sapiens
aggctggagtgcagtggcgcaatcttggctcgctgcaagctctgcctcccaggttcacaccattctcctgcctcagcctcccaagtggctgggactacaggcacccaccacgcctggctaattttttttgtatttttagtagagacggggtttcaccatgttagccaggatggtctcaatctcctgaccttgtgatccgcccgcctcggcctcccaaagtgctgggattacaggcgtgagccactgcgcccggccttcacctgttagtttttcaagaggtgttcgtcatgtccactgtgatagttattttgtgtgtcaacctgactgggccacggggtgcct

SEQ ID NO: 73402 - DNA, 579 bp, Homo sapiens
caaaaaatatcgattccacgaataatccccaaaacaatgcatgaaagttccagttgtttcacacacctgtccagctctttctgattatagtcatccagcagacagtgtgcatttacctgatgtgtaatgatttcgagtacttttcgatgtgcttattggctatttggattttttttttttttgagggcacctgttgaaaccctgtctgtactaaaaaaattagccaggcgtggtggcctgtgcctataatctcagctactcaggaggctggggcaggagaatcacttgaacccaggaggtggagttgcaggtagccaagattgtgccagtgcactccagcctgggcaacagaatgagactccgtgtcaaaaaaaaaaaaaaaaaaagattgctgcttaatctttaatgagcataaagatcaacttgagatctgacacctgtttaagaattatttgcctggaccaagataatgaatctactctcctatgtttccttctagattctttattgtttttttatgtaggtctgtgatctactttgaataattttttgtagcgtgtgaggtaggatcaaggtgtg

SEQ ID NO: 73403 - DNA, 405 bp, Homo sapiens
gactgttggactcattgatcaatatttgctcaaaactgaatgttatagctggacgtgatggtgcatacctgtggtcccagctactcagggagctgaggctggaggatcacttgagcccaggagtttgaggctgcagtgaactatgatcatgccactgcactccagcctgggcaacagaatgagactccgtgtcaaaaaaaaaaaaaaaaaaagattgctgcttaatctttaatgagcataaagatcaacttgagatctgacacctgtttaagaattatttgcctggaccaagataatgaatctactctcctatgtttccttctagattctttattgtttttttatgtaggtctgtgatctactttgaataattttttgtagcgtgtgaggtaggatcaaggtgtg

SEQ ID NO: 73404 - DNA, 285 bp, Homo sapiens
ttttgtgaagttttgctgcaaaggggaacatagaaaaggtgcaggtcctggtataggaaatagggtcgagtaatttctttgttttgaagatgagagaaatagctgcatgttatgtgacgatgagaagagtccagtagaaaggaaaatattgctgatgttgcagagaggataggctggctggagtgacaccctggagcagtaagagatgatgggatccagcagtccagtgcaggattctttgggtggacctagcagttgttcatccacagtcacagggaggcaata

SEQ ID NO: 73405 - DNA, 550 bp, Homo sapiens
gtaatatctgggacagaagagggaatcctttccatgggataaaagagaaacggatggctgggtgtggtggctcacacttgtaattccaacactttgggaggctgagatgggaggcctgcttgagcccaggagttcgagaccagcctgggcaacacagggagaccccgccccccagtctctccaaaagaatttaaaaattagccaggaatggtggtgcacgcctgtggttccagctacttgggaaactgaggtgggaggatcacttgagcctgggaggttgaggctgcagttagccatgatcacaccactgcactccagcctgggcacaaaggaagaccctgtctcaaaaaaatttaaaaaattaaaaatagaaaagagaaagagattgaaaaaaaaaaaaacaagcctccagccttgaaaaatttcaggtcttgggtggatgtcaagaagagaaggtcaactggttcatcctcctgcttctacagggccctaccctaaaaacattccacaccaataccaaaccataaccaaatggtcatgcaaagtaatt

SEQ ID NO: 73406 - DNA, 644 bp, Homo sapiens
tctgccaagcagagcaaagccccacctccctctcgctttgactccctgtggggaaatgtgtcggtttgtatgcagtatagatagagcacatatgcctggtttttcttcctttggggaggaaaaaaatgttactacctaaaaagaaaactggctgggtgtggtggctcacacttgtaattccaacactttgggaggctgagatgggaggcctgcttgagcccaggagttcgagaccagcctgggcaacacagggagaccccgccccccagtctctccaaaagaatttaaaaattagccaggaatggtggtgcacgcctgtggttccagctacttgggaaactgaggtgggaggatcacttgagcctgggaggttgaggctgcagttagccatgatcacaccactgcactccagcctgggcacaaaggaagaccctgtctcaaaaaaatttaaaaaattaaaaatagaaaagagaaagagattgaaaaaaaaaaaaacaagcctccagccttgaaaaatttcaggtcttgggtggatgtcaagaagagaaggtcaactggttcatcctcctgcttctacagggccctaccctaaaaacattccacaccaataccaaaccataaccaaatggtcatgcaaagtaatt

SEQ ID NO: 73407 - DNA, 613 bp, Homo sapiens
aagaactgagggagtgacagcagcattaagaagagcccactgcattcctgaagtctgtaccgtggcagaaagaaggatgaacactggaaatgaacctgagcttgagacaggccagcatgaacaatagaaagcctgcatgattctggcatctcatttccgtgggtcggcttccctaggatgttcctgcttttctcagatgcttcccttcttcaataagatgtccaagattttcacagtggctctcttttgacttgacaagatgttggtactgaagaaaccgaagtctcagttcttcacatgtagtgagtcaggatgcatagtgtttacgagcaggggagacttctttgagccttagttttttgtctataaagggtaaatactatctccctaataatgtctaccagaaatcaaatttaataattcatgacagatactttgcaccttagctgctcctccttgtattgctgtttatctactctaccacatttcttgtattcttagttggtttgtaatattgttaaataccaagaccatgtcttaaatctcctgtagctctagtgtctagttctaagcactgtagatactgggactcagtaaatctctttttatgaat

SEQ ID NO: 73408 - DNA, 504 bp, Homo sapiens
tggcaaagagcttgttggaaaggattcaagctgcagaccatctcaagccaaactccaactgtatttttaatgaatcagttgaagcaactcgatggaaaggacgggtcttgctccatcatccaggctggagtgaagtggcgcaatcatagctctctgcatcgttgacctcctgggcctaagtgatcctaccaccttgatctccttgccttaagtgatcctaccaccttaaccttctgagtagctgggactacaggcatgtgctgctacacccagctaatttttttttaactttcccctgagtcactggaattataggcgtgcaccaccgtgcccggcagtcagtgagtacttactgagtactgaccacaggcctttccctcatggaacattcatgactgaggacacacacaacccttaaatggacacctgaaaatgacataaggtccaccaaaaaatggaagggctgctctattaaactacttaaaaaataacttgtatgtattc

SEQ ID NO: 73409 - DNA, 789 bp, Homo sapiens
aaaaaaaaagtgaaagttcttactggtgtcttaaatatcaagtaaaacaggttcaaatcaataattaacaatctttggttcctgcctatagcaaaaaggtaaaatggaaagcagttatacaaatagtatgttaactcataagaaaactagccaaagacagatttattatcatctgctttttttgttgttgttttctcgagacggagtctagctctgtctcccaggctggtgtgcagtggtgtgatctcgactaactacaacctccacctcctgggttcaaatgattcttttgctgcagccatctgagtacctgggattacagacgggcaccaccacacctggctaatttttgcatttctagtggatatagagtttcaccatgttggccatactggtcttgaagtcctaacctcaggtgatccacctgcctcagcctgccaaattgctgggagccacgggcctggccaatcatctgctttttataggtgataatactgaggcagggagtagttgtaaaatggagtctcagatcatagctataccaagcagggaatctggtttcctgtcctggcagtctgactccaagatcccctcttagaaaccatcatactgtaaaaactgaaaggaaataaaaatccaagattggagactgattttaacatctattcatctaaaccattaagtaatcaaaaatgaattaaatagaggaaaatacaactgactattcatacacagagaagtgtagactcttcaatggaaaacatgttttttaagtgcccaaggaatagt

SEQ ID NO: 73410 - DNA, 315 bp, Homo sapiens
ctctatagtatctccagtatggccatgtttggcaatgggaaaatttaccattatgagttgaaataacaaaaaaaatgaacattgtggctaaatactttaagtcacactggagagggaaatgaattagcaattcacaagtcaggatccaattttaagttcaaagttccagttgagccaacctgaaaccagcttgtaggcaaagcaaaactaaacctcaagcatataagtgtggacaacaagcacatttttattttgttatggatactaattgtttcaatccaggcaaaacaccaaatatctttaaaaggtaattgg

SEQ ID NO: 73411 - DNA, 434 bp, Homo sapiens
attaaatccacattaagtaagctggttaaaatgaatatttatactctactttgaaacttgtcaagtgaaataatgagaatacatatttatttttaaatgttagccagaatagttgaggctactgtcatttttggatagtttttcaaactgaagaaattgagaattggaactacttcttcaaaagaatttaaattcattgataaaagaaaaatagcataagtttttatttggattggcaccatatatgatggcagggtttataaattaaatcttgcttgtgggtggccatcaaactgaagagaaagcagtgtcatctgaagccacagccaccaccatttcctgccttctagccactctgttattctcctggtcctgctaaattcataactaagatggcaagtggtgatttgctcattttctttcatttggttgta

SEQ ID NO: 73412 - DNA, 405 bp, Homo sapiens
ctgggattacaggcgtgggccaccacacccagccagttgtgtcttaaaatgacccacattagggctgcagacaaaggctagggaagggagaaaagatacagccagagaagaaaggcaaggacatcattcagaatccctgaagcagccagggaagggagcttaaactaggaaggcattacctacagcctcagaagcaaagcagtagatagggtaaggagaattgggatgaggaaagactctaaatttggtgattatgggtaggttggtgaccgcaagagaagaattccagaagctaagagggtgcaggaagatggactgtgcaggactgaatgtgtgagtagtaatgaaaggaaacaatgaacataaaccaaactttggggaggtttggtgctaaacagcaaaagc

SEQ ID NO: 73413 - DNA, 295 bp, Homo sapiens
cttcataaatgttttgtagcttttgtacagtcttgcacatcttttatccaatttatcccggagtgtttcatattgtgatgcttttgtaaaatgatttagtttttaaaatttcagtatctgttcattgctattatatagaaatgtaattgatttttgtgtcttggtcttacattctataaccttcctaaattcttttattagttttagtaactttttaatagatttcatcaggttttccctgtaggttatcttattgtcagcaaataaagaaatttttacttgtttctttctgact

SEQ ID NO: 73414 - DNA, 328 bp, Homo sapiens
attttaaaatgctagttgagggaagctgtatcaagtgaggacaaatttgtatctggaacttaaaacagggcaaaagctgaaatagagagaagtccatgacactaatgaccttaatatcatagatacagattaaatagtaaattatgatttttctcatctaaatttccttgaaaactactgaggatacattgactaccatcacaaacaagatgctcaataagaaatataagatccctgctcaaaattttgcagaagtgacccatttatgacaatatttcagtcttaatgaatcctgagcatgtaattttcttaaaatagaattttataa

SEQ ID NO: 73415 - DNA, 251 bp, Homo sapiens
gtttttggtccattcattctctctgagctccattgagactgccagctgctctctggactggcttctaatgttcacttcatacatgtcacctcttcatccagctacctcctaattgttccaatctttttttctttctttttggaggtaagctcttctggtacttctttttttatcgttctcacacttcttcagaaactcttctcatggtatacatgttcctggtacacaccactcaagggcagattctgaca

SEQ ID NO: 73416 - DNA, 619 bp, Homo sapiens
gcctctgttcttttttttctactgttctccttccatgccaatgacaccacttacatttcccctagaactgcagattttttttaaatactgggtttcctaaagcagttcttattttatatattctaatttatgtacatgaatgtgtcacatagacctgtcattagagatggtttagaaaataagcttacactatacgtgcctcaatccacttcaaaactacatattgggcccaaagaggaaaagggacttctcagaagaaaagcagtttctgaaaagctggagaacctgactcaattaatacagctgctggttgcccaccactttaacctctgacacctgatagagaagcttcatgaaagcagcaatgattattaagagagcaaagcaaccacagggaaaagggaaaatcttcaagcaaagacttgaagatagagacatggtagggggagatataaggatgctatattcatagcaaagtaccacagactgggtgccttgaagaacagaaatgtattgtctcacagttctggagactagaaatccaagatgtcagcagggttgtttccttctgagggcgtttagggaaagatctatcccagggctctttccttggctttgt

SEQ ID NO: 73417 - DNA, 2482 bp, Homo sapiens
gtgggctgcctggggggctgatgccaccattccaggagcctcggtgaagagaggatatccatctgtgtagccgcttctctatacgggattccagctccatggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtgagaacagtgagcttggaaaggaccagtatgcttggactgaaggggttctcacagtgggagccagggctgtcttcgtattcccattagaccaagcttgtccaacccgaggcccgcatgcggcccaggatggctttgaatgcggcccaacgcaaattcgcaaactttcttaaaacattatgagtttctttttgctatttttttttttttttttagctcatcggctatcgttagtgctagtggattttacatgtggcccaacacaattcttcttccaacgtggcccagagaagccaaaagattggatacgcatcagacagatggaaaagggagattcagactgtttttcagggaggtggctgggtttacacgctaatcccgattcaccctgtccaaactgcctaagccctccgccattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctttgcccacaatgctttgcccctgagacaaatggaggcctgtcctgacctgtctcaccatgtacatagcttgataaagggccaataaatatgatgttatggtgaaaaaaaaaaa

SEQ ID NO: 73418 - DNA, 1320 bp, Homo sapiens
  misc_feature (1)..(1): n is a, c, g, or t
naactgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaagcttccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 73419 - DNA, 1276 bp, Homo sapiens
  misc_feature (1)..(1): n is a, c, g, or t
naactgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtcttccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 73420 - DNA, 2102 bp, Homo sapiens
  misc_feature (1)..(1): n is a, c, g, or t
  misc_feature (852)..(852): n is a, c, g, or t
  misc_feature (1159)..(1159): n is a, c, g, or t
naactgcagccgaaccctggtccctcctccacaatgtggcttctcctcactctctccttcctgctggcatccacagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcccactgccaaagccgcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaaggtgcgtgaaaggatggagctggatgcgaggcctcaaggaatcctatgctccagggctcttgggcggaggggacaagggccggaatttatggatctgctccaagtccactgtcttccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgaggtcagagcctagaggggccatcaggcggaagaagagggatggggacaggtgtgggagtccggatggggttggattttcttngctttgggccagagaagatgctagggttaggcttggagatggagtaggaagagaagttagaataggggtgaggttggagttggggttataggtggggattgcgttgtttgaggtggataatgtgatagttagtttgagatggcatgggttggggttgagaatgggaatggtttggtttgattctgggtgggaaatacgtcagggttgaattgggatgaggtagattttgtttggaatgcagaagacatgaagattgagattggattttgagatgggcatgggtttgatttgattttgaatggtgagnatgtgggctgagttggatttaacttagtacagttgcactggagttgcatgggggtgagattggatataggttgggtgagttgtattgagctgtgttgaattggggttggggttggggttgggttggctctgtttgggataaactgggctgtattgagttgagttgggttggggttccctgggatggggatggattgggtttggggtgagattgcaaatggtgattaggatgaggatgaatccaggaggtttcactcaacctgagaccccctcttttccccacaggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactga

SEQ ID NO: 73421 - DNA, 430 bp, Homo sapiens
tgagcacatgacttaaattcaagctactgcacagctttgagatctgagtatcacatggaagcatccaggtggcccctggcacacaggctggtggttcttttgtggagagggagagaagaggggctgctcatggggtagtgcaggtgctagaatatcctgttaacctgttcacactgcactgcaattcgggcttcggtaagctcatctaaagagtttccaggccaggcacggtggctcacgcctgtaattccagcactttgagaggccaaggaaggatcacgtgaccccaggagttcagagaccacagtgagctgtgatcgcaccactgcactctagcctgggtgacagagtgaggccctgtctccacaatatataaataaaaacattttgggtttctgttttggagacaataaattaaatctataaccta

SEQ ID NO: 73422 - DNA, 843 bp, Homo sapiens
ttcgcggtttgattctggggtggggcggcacgtggagcgcgccgctatttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctgtaagatatacagaacttctttgaatgttttgtgtgtattagacatttgatcaattgaagcagtaccaacaatcattaattgcaagtgacagtttttgcattaaagagcagtgacttacatcaagtcaacatcaagtaattaaactaatttaatcatattt

SEQ ID NO: 73423 - DNA, 1162 bp, Homo sapiens
ttcgcggtttgattctggggtggggcggcacgtggagcgcgccgctatttcctaggccagcgggcggttgtctgtggctccgcgactgggcgccccgtcacgtaggttacacacacaatcactccccagggacggcccggagtccgtccaggcagctgcgccctccccagacccgggcaccgcggaggctggagccgcaatggtgctgatggagggcgggagatggagctgaccaggggccggaggggctgagaagagcctgcccaagtctgggccaagcacgaagccctttcccacccgtcgggctcctgggttcccgccagccgatttccagccgtcagggtcacgccactcgctggaaaccctgaactctgtgccccccaagccctgggccccctgcgggaatgttcaaaaatgagtaccagggaggtgcatttgttgaaattttcagtgctcaaggaaaaaatcctggagcaaaatggaagatccttggtagtccatctgtgatttggaaagagtttgataaagaagttaaaagttttgtgtttgtcctggaaggcagcagccaaacaaacaaaattcagttaccaaaggagaataagcaaagccttggattgatccagaggtttcttgtacttcagatttacgtacccctgggacaagacttctccactgaattgctaattactgatttagggaacatcaaaagaagattatatttatcaacggtccataaggaactatcctccacccctcttcatgcaaaaattccactcttcatgatcaaacgtaaaatttggtgcaatctatgcattgacttagtagcattcaccagtgaaatattcaagggggcagttttccagtcattggatggaattgttgtctcagctaactgtagctacggaagatcttcaccttaaaatcaaagccacaagacactgctgataaggatggtatgttcaggttgctatcaagattttttaattctctgatgtatttttaaaattagccatacctttgggatagtatgagtgtgtggtagcagtttgatgttatgtctgctaaagtaaatttgtcaacagtcatgctgatttctttgttctagatcaaatgtttatttttactatagctgaatgtcacaaaaaaggtattaatcttcaaa

SEQ ID NO: 73424 - DNA, 141 bp, Homo sapiens
ggtcgcgagtcccagcagctggcactcttccaatgccctgggcgtgcccttacaggctgccagggcggacagccccaagcctgcttagccccttgcatcaggacttggatctgatgctgccatattgaaaagaaggcaaca

SEQ ID NO: 73425 - DNA, 1257 bp, Homo sapiens
ggttattggagggctgaggctgcgcctgccccaggccaggtcccgccgaaagcatcaagtcaggtaaacaggaggggctgcgccagtcttggtagggaggcagactccacatcatccgcctttggggcgagcaggctcacttgagatctgcctgggccagccggtggcaggtggagctgcatggctgattgcacactgccccaaggctcctggctccaaacccaaggagggagcccaagggcctgtcctgggctgcggtctgaagcaatgatgctttcctgggagcctgttgttgggtgggctgctgcctgccccagccccatgacagcctggatcttcaaaaagagatccctacctctgacctgccactcccaaggagggaaaggagtagccagctggtaccctccctgaagcccagcttcacaggacagcactgccttggggctgctgtaaggaagtggcagaggccgctgggcccagcagtttggctgcatgggccccagaaggcagcactccgacctgggggtcctggggctgggcctccccaagaactggtgcggcccaggagacaggcgagggcacaggatggggatgggagctgtcccagttctacagtcagaggggaagtggccctggtgcttctgccacgggtcccgcatgccagtgatgcccacgcacccccacaaatgctccttcccacctgtcaggggctggcatcagatggcacaggcgcatgtcgggtctgccctggatctgtctggctgcatctgggtccgccctggcaggggcccagcatcttcagccaggggctccaccagcagccctgccagccccagcaggggaggctacaggcagacacccacgggtgctcattgggccaggcactcaagtaacccacagccgcctctcgggcacaccacttgtcccctaagtgaccatggtggagacagcagctccagccccagtacccccagggtcatggacctaggctgagctgagcagtgtccttacagctctgggagggttggggagaggatgggacaggaccctgctgagtggccgcctggcctaccctcccagagactcacgaacaggaggatctgctgtggatgcgtctggggcctgggctcctctgactgtgcacctggggtatccaggcagcccgacacctctggtccaccttgtgctccaggcaggggcccagcagggtgaggccagttcccaggacccctggtcaagggcaccagcttccccatg

SEQ ID NO: 73426 - DNA, 671 bp, Homo sapiens
cgcttcaccgtgcccccgcccgcgaccatggctccgaggtggcgcggcacctgctctttcagtctcacatggcaacgaaaacaacttctatgtcttcacaaggatctgatgatgaacagagaaaaagagaaaacattcgttccttgactgtgtctggccatgttggttttgagaatttgcctgatcagctggtgaacagatccattcagcaaggtttctgctttaatattctgtgtgggggaaactggaattggaaaatcaacactgattgacacattgtttaatactaatttggaagactatgaatcctcacatttttgcccaaatgttaaacttaaagttcagacatatgaactccaggaaagtaatgttcgattgaaattgaccattgtgaatacagtgggatttggtgaccaaataaataaagaagagagctaccaaccgatagttgactacatagatgctcagtttgaggcctgtctccaagaataactgaagattaaacgttctctctttacctaccctgattctcgcatccgtgtgtgcctctacttcatttcactgacaggccactctctgaagacacttgatctcttaaccatgaagaaccttgacagcaaggtaaacattataccagtgattgccaaagcagatacggtttctaaaactga

SEQ ID NO: 73427 - DNA, 336 bp, Homo sapiens
gaactcctgaccttgtgatccacccaccttggcctctgaaagtgctgggattacaggcgtgagccactgcactgggccaacatgaagtcttttatcccttggaagatcagctatttcccagcacagcagatatgtttataaaatctagccatcatgcaagagctagactgagtggttggctccctagtggatagagagcgcagtggtgtgggatggtatggcatggtcatcagggataatgtgaaggagaattgtgggattctcctctcgtggtgacaacctcatgactaaatggtgggctgcagggagccgctccggtggggggattctagccta

SEQ ID NO: 73428 - DNA, 401 bp, Homo sapiens
agcaaggatccagtgcgttgtcataatcccatgaggattttcagatgacacaatcccctcaaatcagtcaccatgttgggtaatgacttcgttcttgctgatctcgtgtgtgtgtcattgtaaatatttgtgtgtccatgttccattttggctactggatggccaagccatgtaagaagatttaactcaagtatttattctttatgttattcagatttctttcaggcttgtgaactgcaccccaatgtttgagtttaaccacctgatccttacatctatccctccccggtgaagcacattccattgctaaaagaaaaagaaacacgaaattgcttcctgttgtctgtataactgttttgatagtttgagatatttgtctataaatgatatttctcagctca

SEQ ID NO: 73429 - DNA, 283 bp, Homo sapiens
atacctaatgcaagtgacgagttaatgggtgcagcacaccaacatggcacatgtgtatacatatgtaacaaacctgcacgttgtgcacatgtaccctagaacttaaagtataattaaaatatatttaaaaaaaaagaattgatgtatatagactgtcctcttataccaaaaaaagtttaaaacctcaaaagcaagtaatatttttacagaaccattgattttgctgctctaaacatgcaaagactgtgtatcctaaccaggctacttctgcaaaatggctaca

SEQ ID NO: 73430 - DNA, 461 bp, Homo sapiens
ttgtgccattgcactctgttgccaggctggagtgagactctgtctcaaaataaaacaaaaaacaaaaacaaaaacccgatgaacatgtactgttttaataaaatgtatgcacatatatgtatgtatacacacactctcacattttatataattaaaattattgtaatataaaagattaaacaagattaaataacctgcctaagattaacctaccagtaaaagaaatagaccagtatctctccatgtctggcctgctctcccagggagtcttaagctctattgtcttttctattaaaactcccattctctaaataaaaatgtctcattcaagtattctgtgttactcagggtgatagaaattcacatgtgaataatatctgctgcttctctacaagagttcagttattacaaatgacaaatatgtaaacaatgaattatagatactggatgctaggaaaaaa

SEQ ID NO: 73431 - DNA, 337 bp, Homo sapiens
cacctgtaatcccagctattcgggaggctgaggcagaagaatcacttgaacccgggaggcggaggttgcagtgagccgagatcgcgaaagagtggaactccatctcaaaaaaaaaaataaaaaataaaaataaagtctattattcataaagaattcattaattaatacaacacgttttatcaacacatatacacaaacacacatatacacacatctgcagtaaaaatttgatgagtgcaccactgtttgcaaaatccaggcaactcaaggaagtcaccaaccaaagcctttgctatgtcctttccccaggcaacctaatcacctgtttgtggctact

SEQ ID NO: 73432 - DNA, 397 bp, Homo sapiens
agcaagtgatacagaataaatgcagtagaaattataggagagagagatcactgagattgtggtacctagggaagagttcatggaggaacagtcaaacggtatcttccacagactcctagccccacacttccaccagtgtttgcacatctgcagttatgtgctctgcttctcatccagcccacaaactctgtttcctcatctgtaacacaaactttcctgctcctgtccagacccggttcccccactgggatactggaacccatcccattttgcctgtgtaaggacacattactctagcatttttcttttctctcttctgtgttatcaatttcttgttctctgctagattattttcattagtatcttgagccttttgtaatttcactcctgaaaacaa

SEQ ID NO: 73433 - DNA, 1439 bp, Homo sapiens
  misc_feature (646)..(646): n is a, c, g, or t
ggcacgaggctggcttctgccactggttccctccatggtaccacacaagggaagatggaagtgggtctgggcaccgggagtgtgcccaccggagactccaagagaaacgtacgagtcgtcccaggaccggggtggtgagcgaggccccattttgtcctcccagggcctagtctcagacagactggggtgagggaggtggggacaggcggcgagccagcgggcagactcaggcctggagctcgtcctgttcccctggccacacaccaaggtgttgctgcctcctgctccctggtggccatgcctgctgtccctcctcactggccttccaggcatgggcgctggctggggagggatggaagcgtgccctgccgggggtgcccctcggactcggtcttgccattcgtgtccgggcctgtgtggtggtctctggcctcgcacggcccgtgtgtgtctggggaggggtgaagcacgccgccggccccctctccccgtggggccgagacctcctggtggtcgcctgcctgatggtgtcccgcccgcgtcccagctgcaagctcgggtgccagggcaacgggcccgcctggccgactactgcgccggggccatgttcgtgcagcagctgctgagtcgcggctacggcttcgangagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagaaaa

SEQ ID NO: 73434 - DNA, 2000 bp, Homo sapiens
  misc_feature (1207)..(1207): n is a, c, g, or t
catcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagcagctgctgagtcgcggctacggcttcgangagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagaaaa

SEQ ID NO: 73435 - DNA, 1991 bp, Homo sapiens
  misc_feature (1198)..(1198): n is a, c, g, or t
catcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgangagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagaaaa

SEQ ID NO: 73436 - DNA, 2069 bp, Homo sapiens
  misc_feature (1276)..(1276): n is a, c, g, or t
catcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgangagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagaaaa

SEQ ID NO: 73437 - DNA, 141 bp, Homo sapiens
catgacattaaagtgtggtttattctactgaaaaataccagtaaataccacttagaagaagtgttgcccagacaaagcaaagcaaacattcatttgatctttccatttccccatgtctcattttatagtaacagtatcaaa

SEQ ID NO: 73438 - DNA, 419 bp, Homo sapiens
tgcttaagactgctttgtctattcaggcttttttggttccacatgatttttggaatatctttttctagttctgtgaaaaatgacattggtaacttgattggaaaaacatttaatctgtagattgctctgggcaatatgaccattttaacaatattgattctttcaatccacgagcatgaaatgtgtttctatttgtttgggtttaacaaagaaaagcctgaccaggaacagtggtgtgcacctgtagtcccaactactctggaggctgaagtggaaggatcacttgatcccagaagtttaaggctgcagtgagctatgatcacaccactgcactacagcctgagtaacagggtaagaccctgtgtgggtcttactaaaaaaaattgtaaaaaagaaagtttaacactcagacacctcag

SEQ ID NO: 73439 - DNA, 1776 bp, Homo sapiens
caagaatatcttaacaaaatatcgttgttagtcggatgatcttattctttttcaaagtcccatggccagatatcctataatatactagatgcatgtttgctaatttttacttgaatttattttaaattgtaccaatcaaaaggttctttttctttccagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaatgtgtttaattttcctttctgaaaactctcattttaaaaacgttcatttaattatgtatttgaattattttggagatgaggtattttatgagtattttcagacaatgaaacttattagtctgtgtcagattctgagcaatcatagagtcatctaagttgtaaataaaaccttgcatagcacaatttatctgtatactttaaattttatttttgcatttgaaattcacagatgtctctcagtcttttaaaacttaagtaaattaaattatacatgt

SEQ ID NO: 73440 - DNA, 1657 bp, Homo sapiens
caagaatatcttaacaaaatatcgttgttagtcggatgatcttattctttttcaaagtcccatggccagatatcctataatatactagatgcatgtttgctaatttttacttgaatttattttaaattgtaccaatcaaaaggttctttttctttccagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaactttgctcacagagaaaagccaaagtcaaaacaaaaaaggggggggcaaaatcccgaggggcaacacagcccggtttgaagggcccaaggggggtaaaagacgccggcccaaggcggaaaggcgggtctgggggcaccctgggggtggacccaacaacaacggcaatgttg

SEQ ID NO: 73441 - DNA, 500 bp, Homo sapiens
gaggacctgcgatagcagacccataccaggcactatgagctttacaggcgctgcaaactggaggaaatgggctttacagatgtgggcccagaaaacaagccggtcagtcttcaagagacctatgaagccaaaagacatgagttccatggtgaacgtcagaggaaggaagaagaaatgaaacagatgtttgtgcagccagtgaaggagaaagaagccatattgaaagaagctgagagaaagctacaggccaaatttgaggaccttaagagacttcaccaagaagagagaatgaagcttgaagaacaaagaagacttttggaagaagaaataattgctttctctaaaaagaaagctacctccgagatatttcacagccagtcctttctggcaacaggcagcaacctgagtaaggacaaggaccataagaactccaattttttgtaaaacagaagttccagagcacagaaggtcatcatcacaagcaaactttattaaaaaaa

SEQ ID NO: 73442 - DNA, 186 bp, Homo sapiens
ctatctatcatctgtctatctagagatgatagatagattgatagatatcatctggagatgatagattgattgatagattagatttgataaaaatctatctattggccgggcgcggtggctcacgtctgtaatgccagcacttcaggagaccaaggcgggtggatcacgaggtcaggagatggagac

SEQ ID NO: 73443 - DNA, 382 bp, Homo sapiens
ttcactttatattttaaatattatgaaatatcatctgtcattatattcaaattaaaattgttttcatataaggctttggaaaaatggtcttttataggaagaaaactgggataattgatttctatggctttcaaagctaaaacataatatattaaacaaactctagtattgcttcttgtgttttactttcagattaaattactgcttttatggataactgaattttaatatattaaaaagagattaagaaaagaaaaaataatttctgtatttacctacaaatttgccatttccaatgtctttcatttatttctgtagatctgtataatgtagtataatttatcttcagtgtgaataattttctttaccacttcttgaggtg

SEQ ID NO: 73444 - DNA, 262 bp, Homo sapiens
ttgcccaggctggagtgcagtgacatgattacagctcactgcagctttgaactcctcccacctcagtctacagatacatgctaccacgccaggctaattaaaagaaaaaaattgtagagatgggatctcactttgtcacccaggctggtctcaaactcctggcctcatgcaatcctcccgccttggcctcccaaagtgctgggattataagcatgacccaccatgccaccagcctgaacttttgaagcaagtgaatgtttag

SEQ ID NO: 73445 - DNA, 337 bp, Homo sapiens
cctttattgttgttctgactttctataaaaccaataacacaaacacaaaaataatagcaaattgtatattttaaaaagttgcttaaaaaacagcactacatcaatttgttaacaataacccgtggctaatttatttgtaaagtttaaaatcacatcaataagaatatctccaaatatatataatgtagtttcagaattctatccactgaatttccttagagtgggacaattgttattttcccatgcgttcatgtgacaatgttttctgcaaatgtggagaaatattggggggatttgtaacctttttcattgctaataaaaatagtaaagtctgaaa

SEQ ID NO: 73446 - DNA, 419 bp, Homo sapiens
tctttcaagataggatgaggagatcagtttgccttttaaaatagaccccagataacatgctccatgttgagcatgacctggcttcccagtggagagatggagaaaataatcctggtgcaagttgctggagagggagagttgattagcatttgtttccttgagtaacaacataaaccacaagtgatcgagtgcatccctgcttggcaggaggagaatgactgttcataaatgatgcccttctccatttccagagctcttgtcagcttggcttcccaaagtggtatcactcatctgtcaagttgattgggtctgacccagacaaagcaaaccagaggcaatctcaattacgacacatttgtaaatgtcctgtccaactcattccaaagtccaaataggtgaatcagaattcgcaaaaaaaa

SEQ ID NO: 73447 - DNA, 479 bp, Homo sapiens
ctctgggagcctggaatgtgcaggaaccagctggccttggagtgctgcagactccaaggtgcgtcacctgcagttctgatccctgttctggatgcaacccaggaccctgcccttgccaagcatcccaggaacactggcactgatggctgaggctacatccaagacagacggtgaggaaggccccaaggaaagggccgtgtgggacacattgtccttcccaagatgatgagtctgagcctggcaggggaggcactgggagggcctgttgtgggcagttcattcaatggacacagggtggcaccgctctgtgtcctctaatgaccattagacacctctaaccatcacatgatgtgcagctcagcttttccaagggcctggaagtgaatatttcaggagataacgtgaataacccactgtattcatctgttctcaggctgctaataaagacatacccgagactgggtaatttataacagaaa

SEQ ID NO: 73448 - DNA, 751 bp, Homo sapiens
tagttgcagaacggtgtttcagcgaagttgattggagagttacctgattatagtgagattcttatccaatccctacagaattgtgagactaaatgttggtgcagcatgtttggtcctcaaaaggcaatgtccaagaggaacttcttatccccgaaaaatcaggctgtgtgactcagcaaaggaattgtttatgactggttactcatatgccagtgcttccagaatatctgctcgtatttaaaggagtgatcttgaagccccagaggccataatgtttagattaccaacctcttcaccaatcagtaagtccattacatctcactacgtgttagacatgggacaggagaagaggatttttattacctcactgttattactggaggccgcccaaatttgttttttgttttttttttttaaataaagaagcttgttttcatggaatggacttactagaacttttattattcagactacctagataaaattaagtaaattcgtttctttctcccaaattaaatattttgactacatgcaagatttaatcattcaaaattgccatgtatttgattatagaccagtagtataatccccctgccccaggccagattccaaaacaataaaccaaaacacacacacacctggcaacagaaattatatgtattccgagactcattcattcattttggaaagggccagtgtttccagtggtttctccttgggattgtaactttacaactttaaaactaggtaa

SEQ ID NO: 73449 - DNA, 1047 bp, Homo sapiens
  misc_feature (105)..(105): n is a, c, g, or t
  misc_feature (146)..(146): n is a, c, g, or t
gtcggcgaacgctttgggaaaccaaagcccatcacccaaaatgtctgtcccagatttctcaatgcaagcccctggcatggccccatccccttcattcattatganccctttttggaaagaaacccttttgaagaggtttcccatgnatgagtgcacccaattcaagttgggttagttggcttctgtttggtgtttgctacaccctgtgttgtgccctgtttcctcagaaaagttccatgtctgtgacaagcttggaggccgagttgcaagctaagatccaagagagccatcctgaattgcgacgcgtgtacttcaataagggattgtaaagcagagaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatacggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttacctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgc

SEQ ID NO: 73450 - DNA, 1060 bp, Homo sapiens
cagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccaggtaaaataactaatacgtccaattttgcttctctgccaaatcagcaagctttagtaaaaacccccagttacagttctgctccaggtggcactaccattcacacggcttcggcaccatccaatgtaactagtctagtcgggagtcagttcagtgaaccttgtattcagcaaaaaatagtcatcaataccagtacacctttggcacctggtactcagattatgattaacggaacccggtttattgttccaccacaaggtcttggagctggcagccatgttctccttatatctactaatccaaaatatggagcccccttagttcttaacagtggccaaggcattcaatctacaccaatagataactctgcccagaagatcacactagcatcaaataattccttaagtgggccaacctctacaacatcctcttaagaagccctacaaaatttattaaactcttttgggaatgcaagttctat

SEQ ID NO: 73451 - DNA, 960 bp, Homo sapiens
cagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccagtgagctttctcttaagtgtgccaagctgccatccaactttcttgagcattttttctcatgggaaatgatcaagttttgatagcagaaagtgcttctttccaagactttctcgaggccatcttcctgtaggcgtcatgcttctgatgttacacagctgatattttcatatgagctgcatttttagactacaaagatgcttactcagactcagcccaagtctccatgtccatcacctgggacactgtctgaggaactctgtgaggagagccttttccacagagaaatgagagcaccctcagtatcgctctgaagacttgatgaaggtttgctgacaagaaagggcttactcactgtacacagcccttcaataactcctac

SEQ ID NO: 73452 - DNA, 1121 bp, Homo sapiens
gtatttcctccaatattggagtcttgttcagattcatcaactcctcctccttcccactagatgtcagcacactagagggctatgctcggtgggtgtgtcagcccccagacttgacttgcctttgatggtttgtatttgtatttatgctctggaaagacattggggaacaggagacatgagacatgagactgcccaagtttcttggcaaagagggaaagaatccagagttgtatctctcaccttctccttatcagcttgccaagcttcaatccccaccccacaccaaccctcctctctttcacaggaccttttcctctaaatgaagtgcttgctgaatgaggaatgggactttccaacatcttttggaaagatactttttttccattatgcatcaacctgaaaagctttcagatctgtaataacaagaaagagagacagcgagatctatggagaatgccttcgggtgctgaagtgctgaagtgctacctggctttaagcaagattgctgaaacctgtaatttttatagcttataaactcagttgatgtttcccattcatggaggatactggtaccagaagattggattgtgtaattgtgttagcttcctgcatatttgggtaaagaagaaaaaaatactattaaaacctttggccatctaagaaggatgcagcctgttaaaaaacacacaagtgaccctttgtgctgatgcaggaaggatggtttcctcatcgcactgatgatatcctgggatgcttagtgtagagtcagaagaacttggaattcacaggtaaccagtgaggaaaggggtgaagaagaaaagtaggaagagcaggtcacaaagtggagtaacagaaccagcaagaattcccagaagtggtaaaacctgaggtgtctaatatactcctgtttgctataagggaacctcaaaccccttcccctgtgccctataaaccgtcagtgcttagctacacacaacatccaggtacccaagtctgctatgagtagaaccaaagagacaggtgctatagtttgaatgtgtcccccaaaattcgtgtattggaaacttaatccccaatgcaacaatggtaagaggtaggacttttaagaggtgattaagtta

SEQ ID NO: 73453 - DNA, 412 bp, Homo sapiens
cctcacctggagtggtatgatggcagtcaggagcaaggcagtttagggaaagctcctcagaagaacttggaattcacaggtaaccagtgaggaaaggggtgaagaagaaaagtaggaagagcaggtcacaaagtggagtaacagaaccagcaagaattcccagaagtggtaaaacctgaggtgtctaatatactcctgtttgctataagggaacctcaaaccccttcccctgtgccctataaaccgtcagtgcttagctacacacaacatccaggtacccaagtctgctatgagtagaaccaaagagacaggtgctatagtttgaatgtgtcccccaaaattcgtgtattggaaacttaatccccaatgcaacaatggtaagaggtaggacttttaagaggtgattaagtta

SEQ ID NO: 73454 - DNA, 1522 bp, Homo sapiens
ccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccatctcatccccttccagtgtcagcaatacattcctggtaacatcaaaggtgttcagaatgccaatctccagagactctactcttggaaacacagaggagacatcactatctgtaagtggttccttgtcacaaggaaccacttgggaaaacctgaaatttaaactgctttagtcaactttgtctattgtgatcattttcttttcttatttcagtgagctttctcttaagtgtgccaagctgccatccaactttcttgagcattttttctcatgggaaatgatcaagttttgatagcagaaagtgcttctttccaagactttctcgaggccatcttcctgtaggcgtcatgcttctgatgttacacagctgatattttcatatgagctgcatttttagactacaaagatgcttactcaggtgggagaccatttctttgaactgtaagtgatttatttgattttctttttaatagtccttgtttttctccttcaagcctttttaaggaaacatttaacagcatcaatgtattttttcaaattgctttttgatttacctagaagttctcaattttctgatttgtgtttgtctgatttcaagttgccatcatccatgtaatttttgctaaagaagacaggcaagtgtatcaccttccatatgatttaagagattttaaagggctctcttttacaacctctttatgttttcaagttgtcaagcatttttttcctccgtttctcacactttttattccatttcacagcttcttgggatagcgcttttagattttcctaaaaatgagtgttttcatccaaacaacccattatttccttctgaaagttcttttgagacactttaaagatgtttttggcgccggttacttgagattgacagattttgatgcatcatcatgtaactgttgaactgtgaaatgaaagtttagagactcccttctgttctttttttgagaaggtctgcaatattctcaagtgacaagtgaacctgtccagatatttactaaatgctaaatttaacatttgtgacttcagaggactggtctccaccagagataacttgaaggcttcattgatttgtataatcagtctaaattttcactgactttaacctgggcagaaaatcttttggctagctcttgttccctccttaaagtatgcctgctctttactataaaaacaatcagagagaccatatcagaatcttgcagggaaatgcatagagacttgagccttgtcttaagcatcagtcaccaccactgagggctggacaggaaggggaaccccaggttctataaaacaatactctctaactttgctcaccatgcaaataaaagtactattatttgtacagtga

SEQ ID NO: 73455 - DNA, 1697 bp, Homo sapiens
cagttccagtaagctcaaattttgtgagtcagaatattacccctgttaatgaatcagtggtttcttcagcaagagcagtaaatgtgctttcagttaccggagcaaatttatctttgggttcctttccagtgacctcagcctctgcttcagctggggcacaacctcctgttttagtcagtggaaatgatacctcttcaagaattatgcctattttgtcaaatagactttgctcatcaagtctcggaaacactgtggctatatcaactgtgaaaacaggacaccttgcatcatctgttctgatttcaactacacaaccagtagtgtctcctaaatgtttaacatcagctttgcaaattcctgttacggttgccttacctacacctgcgactacatcccctaaaataataaacacagttccacattcggcagcagtaccaggagccacacgttctgtatctatttctaaaagacaatctcggacttcactccagttccattcaccagggatttcaactacagtgccaacaaatgtaaacacaaataaacctcaaactgaattgtcgtccctttcaacaagtccagtgagctttctcttaagtgtgccaagctgccatccaactttcttgagcattttttctcatgggaaatgatcaagttttgatagcagaaagtgcttctttccaagactttctcgaggccatcttcctgtaggcgtcatgcttctgatgttacacagctgatattttcatatgagctgcatttttagactacaaagatgcttactcagactcagcccaagtctccatgtccatcacctgggacactgtctgaggaactctgtgaggagagccttttccacagagaaatgagagcaccctcagaccttttcctctaaatgaagtgcttgctgaatgaggaatgggactttccaacatcttttggaaagatactttttttccattatgcatcaacctgaaaagctttcagatctgtaataacaagaaagagagacagcgagatctatggagaatgccttcgggtgctgaagtgctgaagtgctacctggctttaagcaagattgctgaaacctgtaatttttatagcttataaactcagttgatgtttcccattcatggaggatactggtaccagaagattggattgtgtaattgtgttagcttcctgcatatttgggtaaagaagaaaaaaatactattaaaacctttggccatctaagaaggatgcagcctgttaaaaaacacacaagtgaccctttgtgctgatgcaggaaggatggtttcctcatcgcactgatgatatcctgggatgcttagtgtagagtcagaagaacttggaattcacaggtaaccagtgaggaaaggggtgaagaagaaaagtaggaagagcaggtcacaaagtggagtaacagaaccagcaagaattcccagaagtggtaaaacctgaggtgtctaatatactcctgtttgctataagggaacctcaaaccccttcccctgtgccctataaaccgtcagtgcttagctacacacaacatccaggtacccaagtctgctatgagtagaaccaaagagacaggtgctatagtttgaatgtgtcccccaaaattcgtgtattggaaacttaatccccaatgcaacaatggtaagaggtaggacttttaagaggtgattaagtta

SEQ ID NO: 73456 - DNA, 608 bp, Homo sapiens
ttagaatttatacttaactgtgaagttcaaactggaaatcaacctcatgggtttaaagggagtataaattcatttatgctgataaaacattataaacgatgtctatcattgttactttattgtcatgtacatgtattttcctttgagaacacagcaaatgagcatagcttacaaacccaaaactctaccttaaaaatgggatataattagaggataataatgtcagacctcctgtccagaatgctcttaaaggaattccccttagagtcaagcccagctagtttaatgtagtcagaaatgcttatttccaaattctcaatttaaaataaagcagaatttaaaagtgggattgttacatcatgatagtgctttagggtaattgagtatttcatattaattggtattggtaagaatagcatttctgctgggtattaacatatccatatattattctctcatctgtgatcatatacatgttattaatttaagcccccatatttttgtctcctttctcatctctttcattagtgagttactgttttctggtatttttaaaagcagttatcaaattataaaaattttcagcaacttttctattttgagctaag

SEQ ID NO: 73457 - DNA, 173 bp, Homo sapiens
gagctgacggagtcggtgatggacgttgtcagaaaggaggctgagagctgtgactgcctgcagggtttccagctgacccactccctgggtggggggactgggtctgggatgggtacccttctcatcagcaagatccgggaggagtacccagacaggatcataaacacattcag

SEQ ID NO: 73458 - DNA, 784 bp, Homo sapiens
ctgatctctcggctcctctcggcctgtgtgacagacttggagatgtgccacccagatgccccttccaggaaggacttgctcccagctttggggagtggtcagaacatggcttccacctgttagctcttcaggatcttcccagtgatgagccccaaccggcctgggccaagtttttcatgcccagctaacacccggagactgggagagggtcttgggagacccgaggtgggatgctggatgggtactgtgcacttgggagcttccagacaggcctgtaccacagttgaacgtctccctccacccgcttctccctcctgtccaggtgctggaccctcataaacatcttgtatcctgactttgtctcaactcctgcttctgaaaaacccaacccatgacaggcgggtctctctccagctcccaacccacgacaggcgggtctctctccagctgccattagctactccggcagccccttgcctttcaggactggggtggtaactcccagctgtcaccagccccaagatactgtggagggtcatctcagcgattcccagcacaggctgctggctgacagtggcacagttcaggtcgtccattagctttctctgcacaccacgatcctgagacaagcttggctcgggggtcccacagaactggacagcctgttggaaacgggctcccggggatcgtacactcactccctaatgttggtctgtggggtcggagggggcagcaaaatggtggatgggaggagacctcaaatgaatgcgtgcttcacagaaga

SEQ ID NO: 73459 - DNA, 449 bp, Homo sapiens
ggagctattgtggctccggccggttgcgcgggccctcggaccctcagagaggcgagggttcgagggcacgagttcgaggccaacctggtccacatgggtcgaaaaaaaaaaacacaacaacaacacaaaacaacactggttgggggcggccgaggaccacgggggaggaaggtttcgtagcacccaatctccgttggggccaggggcccaggagggtaacggtgcacagtgggccacgcaggtgtgccaagcgggggacaccggggacagacgaacaggggcgtggactctcacgcaaaaaaaaggcgcccgggggaaaccaggactgttccagggaaacaccccacgagggggcgctaagagggggacagaaagggggatctacaacccacaagggggcccagacgcgagcgcgataatcaaaataaagccccgacggcgtggagtgg

SEQ ID NO: 73460 - DNA, 351 bp, Homo sapiens
  misc_feature (218)..(218): n is a, c, g, or t
  misc_feature (225)..(225): n is a, c, g, or t
  misc_feature (227)..(227): n is a, c, g, or t
  misc_feature (258)..(258): n is a, c, g, or t
ggagctattgtggctccggccggttgcgcgggccctcggaccctcagagaggcgagggttcgagggcacgagttcgaggccaacctggtccacatgggtcgaaaaaaaaaaaaaaaaaacctcgtgccgaattcggcagagcaaaggggctacggtctacaaggcagtattacaaacaattactctgggacccaacaagtccagaccacacataaagntcaggantnttaagctttcaagttagaaatgaaatatgangtagcacataaataattcctagttcaaatttcacttttgtttacatttgaaaaacaaaaaagctactaactccctttttgaaagtttcgcatg

SEQ ID NO: 73461 - DNA, 487 bp, Homo sapiens
  misc_feature (319)..(319): n is a, c, g, or t
ggagctattgtggctccggccggttgcgcgggccctcggaccctcagagaggcgagggttcgagggcacgagttcgaggccaacctggtccacatgggtcgaaaaaaaaaaaaaaaaaaaaaaaaaaaaaaaaaaacaatttgtgtggggcgcggcttggggccttggaaaaaagttttttaagaaccatatcgcgtgtgtggggcggcgggggccccagtgtgggtgtaagtgtggacattggggccataacgcgggggtccaagagggagaacccggggcaaggagccaaggggcggggggttctctctcacccaanttaaaaaagcgcgccgggggggagaaacccggaggcggttcctgtggaaaaaatttcccaggtgtgggggttcacgagggggggaaattaaggggggatttatttacaacaggggggttcaaaggggagggtctgagatttaaaatttagggcccgggtcggggggga

SEQ ID NO: 73462 - DNA, 1186 bp, Homo sapiens
ctctactgttagtattgcaaagtatgtatgggaaacacagagaattggagctgcgttgaatgcaaacttgaggtgtttcccttgaggaattcttgtcttcaaacgtctgcagagtaatggaccatgttacaactttcctgttcatctgtgaaccatgaaaatggatggcactgatgcattagaccctcagcagcctgcaattgcaaatctgcgaggtttcattcggcccataaagcaaacatttgaacttacacagaatgagcacttaaatacgggtgcaataaatgaagggaaaaacctcagccgtttctccattctgaagatatagcaagcaccgggaaatctaagatttttcatcaacaatatcttctgccagcccagtttggggggaaaaaccccttttacatttttcttcagtaaagtactggaacttacttttccctgtctgtgctaatgagctgattttcagctgatagaaaacaaaatgatagagtacttttttccttggccaagtattttctcatttgtatttaatttcataaattagacagccagtgaaattagacctcaaactaggtcctgatggataatgaatgttatgtcacctttaacagtgaagtggttattataggtcactttctaatttcatattttcccttttgctttctgctgccctcagggtatatagtgtatctctaacctgatttttcaaggttatttttggagcagtttcttaaaacaggcattccctaacttgctcatttaattaatgaaaaattgaactgatgccatggatataaaaacaaatgcaatgtttgattgtcagtgtttctgatttggcaaaaaggaatcatctctatttttttgcaaacaatatcaaagtgcatattttctctcatgtggtttctatttattcaatcattcatttgtttgctaaggacgccatagtcaaccctttacttggtgtttgttttctatttctgtattcattttccaaggcattttcttttctttattactgttttcaccattggtggggtagggggaagcattttatatctccaacagtttgctgggaaaaaccacactttttccctttctattcactggaaagggaaatgtaactacttctgaagcattctaagtacaactggaaatgctttcttcacctcagttctttcactct

SEQ ID NO: 73463 - DNA, 471 bp, Homo sapiens
tattgttattcaaaagggattagcttggaagaaaaaaaaatgtttctttaaagattggtgattcagaatcaccatccggaggtctagaataattttggcctggaatctctgcaggacttgatctaatctggtgggggtgtcctgaattaataaggtagcattttaatgcatcagtctgcgtattaccacgtctcattcatataaacaagacagtggtcatgaggagaagggaaacaaaccatgtaattggggcagaaaggactacatttttacagctgtgacttaagtggggagaagcatttgttgtgcatctaaccctctgctaggagcttcacagagattacttacattgaatcctttcagttgcccatgtcgtccctatgttagagaatagtgtttactcagcctcacagagccaagcaacttgcctgaaatctcacagctggtaagaaacaactgagacttaactca

SEQ ID NO: 73464 - DNA, 576 bp, Homo sapiens
ggggtagggggaagcattttatatctccaacagtttgctgggaaaaaccacactttttccctttctattcactggaaagggaaatgtaactacttctgaagcattctaagtacaactggaaatgctttcttcacctcagttctttcactctcgccttgcttgcaaatagacttttttattgttattcaaaagggattagcttggaagaaaaaaaaatgtttctttaaagattggtgattcagaatcaccatccggaggtctagaataattttggcctggaatctctgcaggacttgatctaatctggtgtggacagttcccctgccccaacccccacttcccccataagcactgataccagcttctttagtaaaaaggagatgctgagggaactaaggatttttatgtctgctggttcaacattgcccagaacaggtaaacagaactaaatgggtttctcatattaaagaattcctaggagacttgacggcgggagatgacaatgaaggctttctttatgtcttcaaatttatttatcttttcttctttaagaaaccttatatgctgggaatcttg

SEQ ID NO: 73465 - DNA, 293 bp, Homo sapiens
gagatgctatgaaggggagctgtgaaagtcaaagatagaactggtggtggcactacatatgccactgaaagtgggcttgatgggaggatttttcatacttttattaggctattagtggccactcttgaaattacaacatatatcattgatttattaaacattaatgttaactcttaattttccgtcctcccagacaatgcaaggaccttagaacactttaactctattacctccctcctgaacccccatttctgatttgtcaggaatttttttttaacaaaacttaaaaatgg

SEQ ID NO: 73466 - DNA, 577 bp, Homo sapiens
cagtatttccccgggaagtcagccaccatacagctaccagcatgttgtgagagggcccaagctatccacgtggatggagagagaggtgctcagccagccttcaaccatccaggtcagcccagcccaggtaccaaacatgaatgagcaaaccatcttgaacatctgtcccggctgagtcttcagatgactccaaccctagccaccatcccactgaaactgcatgagaatttgaaagcaagaagtgcccagctgagtcctgtcagctcactgaaccatggaagataaaaataaattgttgttttgagccagtaagtttgagggtagtttgtttatagcaatagataactgaaacagtgccctgagtattttaacaggacagtatagttagctctgagcttcttactattcaaagcaaaaaggggagtagaatggattataggcatttattatcttgagattctgtgatttaccttaatgcagggttcatccaactgtctctttgcagtcacatcagaatgaaaattaaaccatcttccttacgtgagaatttctcctatcttcaccaaaactatttgtg

SEQ ID NO: 73467 - DNA, 691 bp, Homo sapiens
agttgttaggagagaccattggggataggaaagatgaaaggtcatggtgagcttcaaggacatgaaagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatgcgaacaactactttcaacaagcatcggaaggcaccacactggacaagactaacgtacccaggtgcaacttctcgacagacaacttcagaggtacaccctgagtagccctggcccgaccaccagacaccggcatgctcctccaaccaatgacattagcgca

SEQ ID NO: 73468 - DNA, 4493 bp, Homo sapiens
atacgtagacaatatccaacctggacaaaacgggcttcccttgcgagcgacctaaaccgatcccccaaagaatagagactaaatgcaaagtgagaagaaacagttgaaggactaggaagaggatcctctagggatgagctggtcactttcatgaattcaaaggcaatttaccagtgatttctgggtgctggggctgatattttttgtgcatatttctcacacagttgatataaacttaagtgaatgaattcattaataaaagcagattttctatttttatttcacctctgggctattttatacctttggagcacacaagcacaacaaaagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgcctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagt

SEQ ID NO: 73469 - DNA, 4352 bp, Homo sapiens
ttccttggggttagttttagtcatatttttatctctataaaacatcaggctgggaggtggtgtgtgcctgtagtctcaactgctagggagcctgaggcaggaagactccttgagcacaggagttcaaggccagcctgtgcaacatagtgagaccctatcactctggaaaaaaaaaaaaaatctgcggagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgcctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagt

SEQ ID NO: 73470 - DNA, 2717 bp, Homo sapiens
agttgttaggagagaccattggggataggaaagatgaaaggtcatggtgagcttcaaggacatgaaaggttgttgtctcatgtaacaatagtagattgttttttttcctaatatttctagccagcccctaagtcaggtgatggaacaaatacctacagtttagtcaggtgaaacaggagtgggtggaggaaggaaagaagaaaaatgggaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaatt

SEQ ID NO: 73471 - DNA, 4614 bp, Homo sapiens
actcactttctgatgttgcacgacgggaaatgctttgaatacttacgacatggccgctcacactgattgccaagattgacagcactaaccatcgccttcacttgttccagggtgaagcccctagtcaccccgctccgcgcgcacctcctggaaccccggcggcaaacttctgccgctctgcgctgcccccacccggggcgggacacccccgcagacttgagttaacgggctacgccggccgcggcgctggggggttctgttcccttgctccccggactgtgacaattgacctagcaccgactccccttccttttaattttttttatttgtatctttccctttttctttaatgccatttactcctgcggcgcagcgcacaaggagccctcccgcgcggtaccatcctggagcccgcccaggtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgcctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagt

SEQ ID NO: 73472 - DNA, 446 bp, Homo sapiens
ctttcattccactgctgtaattactctctggtgttcctgtaccctcaatggcctccagtcattgtcccagatctttaaatgtcttaggatagtccctttctaaattctgccctcctttcccttattcgtccaggtatttctcaagcttgtgagatctcttcttgcttccattttaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacaggtgagccctgcaaaaggcactgacgaactggagatgtggaatgtgccaggctcagagagtaatcaaattgattggcttatttgttgtaagctttcct

SEQ ID NO: 73473 - DNA, 383 bp, Homo sapiens
gtcggccggtccgaaagcttatagtgtaagtgaagagagtagagagctaatagggaaggagaagagagatgtcaagacacttacatgctgatgagctataagggaaagatgaaaggattcgcctgagcaagggatctagaagaatagaaatgtttggatttaagatttcgaagagaccagcctggccaatatggtgacaccccgtctctactaaaaatacaaaaattagcctggcatggtggcgtgcgcctgtagtcccagcaactcaggaggctgaggcagaagaattgcttgaacccgggaggcagaggttgcagtgagctgagatcacaccactgcattccaacctggcgacagagcgagactctgtctcaaaaaaaaaa

SEQ ID NO: 73474 - DNA, 303 bp, Homo sapiens
gtcggccggtccgaaagcttatagtgtaagtgaagagagtagagagctaatagggaaggagaagagagatgtcaagacacttacatgctgatgagctataagggaaagatgaaaggattcgcctgagcaagggatctagaagaatagaaatgtttggatttaagatttcgaagagaccagcctggccaatatggtgacaccccgtctctactaaaaatacaaaaattagcctggcatggtggcgtgcgcctgtagtcccagcaactcaggaggctgagcactataagctttcggtccggccaa

SEQ ID NO: 73475 - DNA, 448 bp, Homo sapiens
atgaaacaagacaatgagaattatagggaagtggtaggtagatttgaggaaattgaagaagccttagagtagtctcagaattcagaaaattgatttaaaaagttagaattgtttggcaggtaaggctggaagcttgaatttactattatctatctgcacaatttaatgattttttccctaatactgtttagtggcccaggattgtgtgacatacagtatatactagtgacatactagtataatagaatgacaaaagatcaagataatgttttttatgttgccagtagtgatggtagtgttagctatcattcattgagcatttctgtctgccagtgctttacctacattatctcactgaattctctagagataattgagttgagaatatttgaaagagagtggttaaagtctaagtttggttgacgtgtaagtgaagagagtagagagc

SEQ ID NO: 73476 - DNA, 918 bp, Homo sapiens
agactccgcccttgggcggggcctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcgatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggacacagctgggcaggagcggtaccggaccatcacaacagcctattaccgtggggccatgggcttcattctgatgtatgacatcaccaatgaagagtccttcaatgctgtccaagactgggctactcagatcaagacctactcctgggacaatgcacaagttattctggtggggaacaagtgtgacatggaggaagagagggttgttcccactgagaagggccagctccttgcagagcagcttgggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctagtggcaatgatggtatatgcattaaggttaatctgaattgtgaaaa

SEQ ID NO: 73477 - DNA, 1805 bp, Homo sapiens
agactccgcccttgggcggggcctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcgatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggacacagctgggcaggagcggtaccggaccatcacaacagcctattaccgtggggccatgggcttcattctgatgtatgacatcaccaatgaagagtccttcaatgctgtccaagactgggctactcagatcaagacctactcctgggacaatgcacaagttattctggtggggaacaagtgtgacatggaggaagagagggttgttcccactgagaagggccagctccttgcagagcagcttgggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcaagatgagttgctgctattctttgcctgcccctggggttctctgcagatggtcccagtaatagatactcagcactagactaacataacaggtcactacacgggtgcagaatcactttacaaaagaagactctgttttacgaaggggattcactacagggacttagagaacagtctcttttctgcctttaaaatgagagttcctccatttaccaaaatttgacacgcacacattcttcaggggcatgccaattgcgtaaagtgaggctcgcctgcatagctaatcctgttaaagacaacttctcaaagcacaacgtgcttgtttcctatcgggctccctgcggggctttctctcactacaagtcaagcttgggctctcaaagccctgcgcctgttaccacggatgcccacagggcctgggcagttgctgtggcgacaggaagagctaatcttcagagagctcagactctctaatgatgctgaaggagcaaaggctgagtcagaaacacacttaagagaaaaggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctc

SEQ ID NO: 73478 - DNA, 514 bp, Homo sapiens
gatagggtagccatcctcagttgtcaagtacgcaggcttggctcatgtacctctttatgttttctcatccatttacacttagacctagaccagacagtgatatttggaactacttgctggatgcactaaggcaggggattcctgttggcatggttctgcatgaatggaacctcaaatggattttgtagattatcctcattgttaccaaaacattttttatttgaggaaaatgttgcaagtatttatactagataatatccactgtgactgtactggaacaaaggtattctgatagagaaaaaagaatgtaatcataaggtccaggaaagagaggtatttcatttatcttaactgatgagaatgttctaatgacaggtatttgctgtagaagtttctaggcctagcttaccctgaaatcaatacacttttgaaagtcagtgtctgtttgtgaggaaatacattgctaaggttttctcttattttctttataaaaaataaaattatgttactttgt

SEQ ID NO: 73479 - DNA, 389 bp, Homo sapiens
aatggcaagagtgatcattctttctgaggaaattcctcagtgaggggatgagccctgcccccacttctgtgcccccatcagcttgggaaattgacatttggtatttggggagggcattgaagtcaagggcagtctgggtgcagcacaagcatctgttggcttgcacagtccgtttccagactttgaagagggagggaagagcctggccacatcaccttccgaggtggtgtggtgtgcaggaaggatgagagaccagccagccctagagctgtgtgtgtatgtgtgtgtgtgtgtgtgtgtgtgtgtgtgtgtgtatgtgtgacgccttctgagacaggacaattggtgaatgcattagcattggcatgcacattaatctttgagggaac

SEQ ID NO: 73480 - DNA, 880 bp, Homo sapiens
agaggtgctgaatgaagacctatcgatgattgattgatacgttaaagattatttcctccttcctcagaatgctacacttcgctcatcaatggagctcaagatgtaaaagtctggtttaagagacattgaatctattctgccttttattatccctttcttataagttgacttttaagaaatcaatgactgtgtggagagttctaactgggtacgtaataaaataaccaactgtgggggtgggcagggggccctatcgcaccaggaagcttgtttattggttgcattagaccactaaagtggaagcactgagatattctggaaagaacacagcttgggggccaacagatctgggttcagagccttactgcatcacctacaagttgtgtctctttagaaaatttacttaaaattactgggaatttatttcatcatctgtacaatgggctacttttttctgtgattgttgtaagaattgtaataactgttaaattgcctagcatggtgctcagtacaagatgttacactctcggcggaatcacttccaagtcaaattggaaattgactgttagccacccatcactctggtttgagaaagctggtgggatagtttacatgcatggcattagcgccatctagtggtgtgttactgcctacgcttccttacggaattctctcttccagtacctttgaatggccacttaatttattcattttattcaacaagcatttattgaatgcctactgtgtgccagacactgatttggcagctgaagctacaacagtgaacaagatagatcatggtccctgcctttagggagtttgtggtcaggtgggaagatagaaataaaataattactgaaataaaatttgaattcaactt

SEQ ID NO: 73481 - DNA, 647 bp, Homo sapiens
tggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactttatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgta

SEQ ID NO: 73482 - DNA, 579 bp, Homo sapiens
tggccaggatgttcttgaactcttgacctcaagtgatccgcccaccttggcttcccaaagtgctgggattacaggtgtaaaccactgcacccagcctgttcatttactttcttaataagcttgctttcactttatggacttgccccaaactctttattatgtgaggtccaagaaccctctcttggggtctggatcgaggcccctttgcagtataacaaggatcaggagtagacaaagaaaagtccaggtccctggctcaacagaatctactctccagcaaacaagataaaacttgctatctccctttaattgaagtccctaatgtttaatggaagtcccagtaggcatccatatggtctctgtatttaccagcggctggaagctcgctttgtacgttactctgcacaacaccacatgactgctcctgacagtaatttgaggagcttctggtgatggtaaacttgcacagtatgttcaaaaccaacctacaatctgtgttacgcctgtatgtttcacaaggaacatgtctgtatatttcgactccagaaatataatttgtcaaaccaattatcgtaccta

SEQ ID NO: 73483 - DNA, 407 bp, Homo sapiens
actagctctatgggatgttgacttacaataatatgtggtgaaaaggttttccagacaaacactgagttcagagttaagcaggtttttttctattgcagagcttgtcagagcctctgatatgcccactagtattgtaagtgtacaagatgaagctttaaaattgggcaaataacagatatttcatacagaatcctggatgtggccaggagtgatgggagatgaaggatcctcttgtcagagtagcactccacagaacacacttggggaaaagttgtcccagggcctgtggcatagtgctctgaattcattttcgcctggctcttaattctggggttcggaaggaactggtcaaacacccacagaagttatctaggatcttattgagtgcttccccctcgtccttccat

SEQ ID NO: 73484 - DNA, 408 bp, Homo sapiens
aataatatcaagttatttgctaaatatataaatgagttataggcctaagactaagatataagagattgacaattagaaaacacttttcaatattaaggtagtatgattttctttaacaattttacaatgaaaataaaaacttaataaaaggtggtaacgggccaggcatggtggctcacacctgtaaccccagcactttgggagactaaggcgagagaatcacttgagcccaggagttccagatctgtctttgcaacaaagtgagaccctgactctaagaaaaaataaaaatgtttacaataaaagtaaaatttaaaatagtaatgtgtccatgaaaactttaattttagagtagttttatatttacagaaaaactgtaaatagaaaggtcccttacagacctatggg

SEQ ID NO: 73485 - DNA, 466 bp, Homo sapiens
aataccactctcccgacgcaccccaaacattcagagttggactttccacacttgatcagggtccaggacacctgggttccacttgattacggctaattaggttatttatttaatgaacagctcattaagatagtcatctgaaatttgaagtgctttcaacaactttcattcattctctcattcattcatgtaagatttttagagcacctaacagatgctaggcactattctaagtcctgggggtacaccaatgaacagagcagaaaaatccccctgccccattcattttgttcatgtgaatactttcttggtgagagtgatttcagctagcacatagtttagagagaatgctgcagagggaggcagatagctgagtttcagggttaacccggagttgcagagttgcgaggcctgctcctgaactttctgaatgaagctttgtagcaagcctttaaaaaaaaagtaa

SEQ ID NO: 73486 - DNA, 758 bp, Homo sapiens
gggactctaaattacacacaccttaatgacaagactccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaaaaaaaaaaaaaaaaaaaaaaaaaaaaaaaaaaaaaaaaaaaaaaaaaaaaaaaaaaccttgtgggccgcttgggcccattcgattttaaattggaccaagtttttccttgcggccgaatttcgggttaattgggccatttggccttttggggggccgttttacatttaatgggccgtggtttaacaacgtatggattgg

SEQ ID NO: 73487 - DNA, 1019 bp, Homo sapiens
agtcgttggtgtatgcaaataagggttctatgacgcagagacgcagcgtgaagcgtgcctataaaaacggaggcgacgcgggggcttggagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaaggataaacggttgatgatcagtggtttggggtgtttggctattatggggtggggtttcgggg

SEQ ID NO: 73488 - DNA, 401 bp, Homo sapiens
atgctgaggtgatctaaggatcccagttcgacggagactctcgaagaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaatctccgtcgaactgggatcctctga

SEQ ID NO: 73489 - DNA, 2190 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaa

SEQ ID NO: 73490 - DNA, 3227 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtacgtggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaagaatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagttaagatttaaaattctcaa

SEQ ID NO: 73491 - DNA, 3165 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtacgtggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaagaatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagttaagatttaaaattctcaa

SEQ ID NO: 73492 - DNA, 3179 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaactgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtacgtggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaagaatgcaatataatgacccgcttttctagaaagttcataatcagctctggaacaagcacacttgattcctcactgtgcttcagaatgagattaagatcagatgttggaacgtgctatgctgtagcgtgtctggaaacaaagtacacaaacctggctacggtgatgagttagcttctgcttactacctgtgacaacccaagtgggtgacactagtgaaccttctccagtctgcaggctggcatagaaggctcttagattatattgggcagcttgcaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagttaagatttaaaattctcaa

SEQ ID NO: 73493 - DNA, 2130 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaatatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaa

SEQ ID NO: 73494 - DNA, 2502 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaaacccataaattaaagaaattatttgtataaaccaaaataaagaaactcctccttaacaaaaaaaaaaaaatatgtaaaaaatcttgggggcccgtttggcccaattcttcttatgactggagcaattttttcctgccgcccccaatttgggcttattttgcccatttgccctttatgggggccgattacaattccacgggccggtttttataacacgtgggacctggaaaacccctgggggtaccccaccttaaatccctttgacctccaacgtgtgcccaccctaatgggaaatggaaatttaacagttaa

SEQ ID NO: 73495 - DNA, 3033 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaagtgtccaaaacctaaattgaatgtactaagttttcacatgtcccattatctaggtccttgtatactaatgttttgaacttagatcatttcaggtgttgtttggtggataaaggaaccttttatttataaagatactgtagaaagcatgtgaacagctctctgcttgattaagatgccataatagtgctgtatttgcagtgtgggctaagacaaagtatattaataagcttttcagcccccccactcccgttccgtagtgtagaagcccacaggtgtagaactcagtcttaaacttcagtatgaaaccagtttccttgtgcgatgatggccactaaagcatagtacgtggatgtcagtgagacagcatgagagccagcagtcatcaaagcgttccacgtttgaagttagcaactgcttaaagttatgccctattaaaattgctttctcaaaagtttgggttagtttcaaatgtgatattttggagggaaggtaaagtaggtatctttcaggtcgtgataatgagctcctatgaaagaatgcaatataatgacccgcttttctagaaaattaagatcagatgttggaacgtgctatgctgtagcgtgtctggaaacaatctgccgaagcagtgacttgcatttccacacttggcttgagcactcaacccagaaggcgaagatagcttttggttgtaggcggcttcctgtatgggatatccctcggtaagggtaaaggagcagaggcaaaggagaaaagcagaagttgcagctgatgcaggtatcctatgcccttgatggatgagactaaaataaaatttttgaagttaagatttaaaattctcaa

SEQ ID NO: 73496 - DNA, 2389 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaaaaaaaaaaaaaaaaaaaaaaaaaaaaaaaaaaaaaaaaaaaaaaaaaaaaaaaaaaccttgtgggccgcttgggcccattcgattttaaattggaccaagtttttccttgcggccgaatttcgggttaattgggccatttggccttttggggggccgttttacatttaatgggccgtggtttaacaacgtatggattgg

SEQ ID NO: 73497 - DNA, 2192 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattaactccgtgactaactacaatacatgtcgccttccccctccgtcccc

SEQ ID NO: 73498 - DNA, 2275 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggtaagacaaaggcctggagccgggggagggctgggcggtttccgctccccgagtgggattaatagtgcggctctcgtcctcaacagaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaa

SEQ ID NO: 73499 - DNA, 2358 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggtaggtcgggcgggggaacaatggcccggcggtggccggctttgtgcggcagcgtccgctcactcctcccctgctcgctgcaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggtaagacaaaggcctggagccgggggagggctgggcggtttccgctccccgagtgggattaatagtgcggctctcgtcctcaacagaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaa

SEQ ID NO: 73500 - DNA, 2204 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggtctacctgggttagggcataccgtggtgctttacacattgtcaactctactcagctcttctgcccctggaatgacctgtcccccagtatgtgcctaactccagatctttttttctattttttatttttatttgagacaggtcatcgct

SEQ ID NO: 73501 - DNA, 1951 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctacctgggttaggtctacctgggttaggtctagttaggtctacctgg

SEQ ID NO: 73502 - DNA, 1580 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtcttaaccacagtgtaacttacagtttcctttaaaggaccctgtacacatttatcaactctagtaccttaatagctacccaacaagtcattaacataca

SEQ ID NO: 73503 - DNA, 2126 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaaactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaa

SEQ ID NO: 73504 - DNA, 2109 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaaaaaaaacaaaaacacaaacaaaccacaaaaaaaaaaaaaaaaaaaaaaaaaaaaaaaaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaa

SEQ ID NO: 73505 - DNA, 1955 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataattaaaactggttatgacttgatccaagtgtttaacaattggggctgttaagtctgaccatacatcactgtgatagaatgtgggctttttcaagggtgaagatacaagtcttaaccacagtgtaacttacagtttcctttaaaaaaaaaaaaagtaaacctggcagctatagaatacactatgtgcatttataatagctattttatatattgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttatagagatggccttccaagtggttttaaaatttactgaagtttttaggtcaattatgtatgttgactaaatttacaaataaacttgtttatccaaaaaa

SEQ ID NO: 73506 - DNA, 1486 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaataaaactggttatgacttgatccaagtgtttaacaattggggctgttaagtctgaccatacatcatggaatgacttaagtacaaatgcaacatattataaacaatttcgtc

SEQ ID NO: 73507 - DNA, 1437 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaaggataaacggttgatgatcagtggtttggggtgtttggctattatggggtggggtttcgggg

SEQ ID NO: 73508 - DNA, 1408 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacttgttgggtagctattaaggtactagagttgataaatgtgtacagggtccttttgcaatctctcacgagatcctgctagagtcaccgagca

SEQ ID NO: 73509 - DNA, 2518 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctccactgcactgtcctctgctactgtcaactgaccttgctctggcgctacgctacttaacggctacctagccgcttgactaccactgctgtaccacgcggctccattaatgacaactaacacacctggctctactgaccttgactccaccgctgcttccaaaccaaacacttggcggacgtgattaacggatcatgtatccactaccatctccacctgctgcactacgcaacatgctggcgacgtatatgtacacaaacggtgctgaacagcactaaccaaagatcttctaagcccacccaagctcgctaacaatataacagaatttaaccctatatctatcaaataacaaaaaaacacaaacgtaaaccacccttggcgccccgcactcttaagaatcataccacacttcactcctcgccacttatccaactacacataccgctctacttcctaacaacatacttcggtaacgtatctccaacccaatcctactcctcacgtctaaccacttgctacacaaacctatctcacctacaagatgacattgcgcggacaaccctcctacggcacccctcaccacccggcatgatggccgatcaattcttcatgacgccccccacaaatcgtcgaacttatccccttccatgaatcctgcccacctgcggcaccctccacctacacatcgccttacccacctcgcccttattgcctcggcacttctatataccccatcgccccctacagtagtcgcgcgacttaccttacccaccaagatattacaacccactatcataaacagagattaaagtggcccaacaccctcaatacagggcatgctaactctctacctccaacaaagagggccccatatcccacatatcccaccacactatataatcccacacacccttgcacctacgcctcgatcacgccatcaccacccatcgtcaacaactagacagacgccaagctaacttcactacccgcgcaccagcgtctggactgggccaacaacacacctaggcgtcagcaaccgtgccccctcccgcctagagccaatatgcgaccccgaccacacaacacgagtgcaattcgcgcccacttaacccactcgtctgcccatccctgcccacatctcgccaacataagacccgtaaacgagcagacaagagccaacatcccgcttcacgcagccaaacattcgacaaaagcacttcccgctccccatc

SEQ ID NO: 73510 - DNA, 1254 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggtttcagagcgcagccatcggtgcgctgcaggaggctagcgaagcgtacctggtgggtctgttcgaagataccaacctgtgtgccatccacgctaagagagtcaccatcatgcccaaagacatccagttggctcgccggatacggggagagagagcttaagtgaaggcagtttttatggcgttttgtagtaaattctgtaaaatactttggtttaatttgtgactttttttgtaagaaattgtttataatatgttgcatttgtacttaagtcattccatctttcactcaggatgaatgcgtgtgaacagccggccactgcgatgcgcgcgccgattgtctcaggcctgagatagtgcagacaag

SEQ ID NO: 73511 - DNA, 960 bp, Homo sapiens
aattcgcggccgcgtcgacacggtgcgagaagacgacagaaggggagtttggtcgttcgttgggcggtgctggtttttcgctcgtcgactgcggctcttcctcgggcagcggaagcggcgcggcggtcggagaagtggcctaaaacttcggcgttgggtaggcgttcgtaggtttacccgcggcttcaggttctgccaaccgttggcgccgcgcgccgcggccgttgggagccgagcggcgggggctgctcgggccgctggcgtcgggtcgggtatggggccgggaggtttccccttggggctttgttccggaactgtgtccccgccttttcccggcggtgattcagaggtcccgacgccgggttccgggcagtcgggcctccgcccgtcgaggaagggaagtgactcctccccgcgctccccctcccgggggaggctgccgctcctcgcagcctgagtcattaggggagggggaggaggttggcggccctcggccatctgctgccgcgaggtggggcgcggggaggcgggaggcccggcggtggggccaggatctgttcctccccccgcagccctggggggcggcccgggtgagcgcggcggccttatcttcggggcgtctttcttaggtgaaagaaaatggcccgaaccaagcagactgctcgtaagtccaccggtgggaaagccccccgcaaacagctggccacgaaagccgccaggaaaagcgctccctctaccggcggggtgaagaagcctcatcgctacaggcccgggaccgtggcgcttcgagagattcgtcgttatcagaagtcgaccgagctgctcatccggaagctgcccttccagaggttggtgagggagatcgcgcaggatttcaaaaccgacctgaggttcccattgtagcgaagcgtacctggtggtctgttcgaagatactagagatacatcatgccccaagaca

SEQ ID NO: 73512 - DNA, 303 bp, Homo sapiens
tcaagcttctaacgatgtacggggacatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 73513 - DNA, 7187 bp, Homo sapiens
  misc_feature (35)..(35): n is a, c, g, or t
  misc_feature (97)..(97): n is a, c, g, or t
  misc_feature (126)..(126): n is a, c, g, or t
  misc_feature (150)..(150): n is a, c, g, or t
  misc_feature (384)..(384): n is a, c, g, or t
  misc_feature (412)..(412): n is a, c, g, or t
  misc_feature (846)..(846): n is a, c, g, or t
  misc_feature (4147)..(4147): n is a, c, g, or t
  misc_feature (5110)..(5110): n is a, c, g, or t
cccacatcggcccccataaccacggtggtgaccangggctgtgagccccagtgtgcctggtcagagtggctggactacagctaccccatgccggggncctctggcggggactttgacacctactcnaacatccgtgcggccggaggggcngtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcnactccggggacgacctggatcctcacanagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccacnacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccatcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctacgcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccctgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatccccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttntctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgntgggccccgactggcacaccccccactgccagccccgcagccccggtgtctagcacacccacccccaccccatgcccaccacagctgctctgtgatctgatgctgagccaggtctttgctgagtgccacacccttctgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 73514 - DNA, 4892 bp, Homo sapiens
  misc_feature (1852)..(1852): n is a, c, g, or t
  misc_feature (2815)..(2815): n is a, c, g, or t
gttgcgagctgttctagaggatcccagcactgtgagactccattgcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccctgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatccccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttntctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgntgggccccgactggcacaccccccactgccagccccgcagccccggtgtctagcacacccacccccaccccatgcccaccacagctgctctgtgatctgatgctgagccaggtctttgctgagtgccacacccttctgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 73515 - DNA, 3471 bp, Homo sapiens
  misc_feature (431)..(431): n is a, c, g, or t
  misc_feature (1394)..(1394): n is a, c, g, or t
aatcgagctcgcaccctgccatttactccatggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttntctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgntgggccccgactggcacaccccccactgccagccccgcagccccggtgtctagcacacccacccccaccccatgcccaccacagctgctctgtgatctgatgctgagccaggtctttgctgagtgccacacccttctgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 73516 - DNA, 3437 bp, Homo sapiens
  misc_feature (35)..(35): n is a, c, g, or t
  misc_feature (97)..(97): n is a, c, g, or t
  misc_feature (126)..(126): n is a, c, g, or t
  misc_feature (150)..(150): n is a, c, g, or t
  misc_feature (384)..(384): n is a, c, g, or t
  misc_feature (412)..(412): n is a, c, g, or t
  misc_feature (846)..(846): n is a, c, g, or t
cccacatcggcccccataaccacggtggtgaccangggctgtgagccccagtgtgcctggtcagagtggctggactacagctaccccatgccggggncctctggcggggactttgacacctactcnaacatccgtgcggccggaggggcngtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcnactccggggacgacctggatcctcacanagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccacnacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccatcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctacgcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccctgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccgcctattttacaccaaccccgtgatcgtggggtgtaa

SEQ ID NO: 73517 - DNA, 397 bp, Homo sapiens
  misc_feature (27)..(29): n is a, c, g, or t
  misc_feature (57)..(57): n is a, c, g, or t
  misc_feature (63)..(63): n is a, c, g, or t
  misc_feature (70)..(72): n is a, c, g, or t
  misc_feature (90)..(90): n is a, c, g, or t
  misc_feature (98)..(98): n is a, c, g, or t
  misc_feature (176)..(176): n is a, c, g, or t
cccttctctggtctgaagaagggggtnnntgtaaacccgtgtttgtggtagtcgccnctttgntatgtannntgttcccggggtggagancggggtgnccgtggatccagtgaatgcagtcgtagtggctgttgtggtcagctctgtgaggatccaggtcgtccccggagtgaagnagggcatggccgtagagctggtgcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggacccttcagggtttcatcactataccatatttaaggcgttctgg

SEQ ID NO: 73518 - DNA, 5089 bp, Homo sapiens
  misc_feature (35)..(35): n is a, c, g, or t
  misc_feature (97)..(97): n is a, c, g, or t
  misc_feature (126)..(126): n is a, c, g, or t
  misc_feature (150)..(150): n is a, c, g, or t
  misc_feature (384)..(384): n is a, c, g, or t
  misc_feature (412)..(412): n is a, c, g, or t
  misc_feature (2049)..(2049): n is a, c, g, or t
  misc_feature (3012)..(3012): n is a, c, g, or t
cccacatcggcccccataaccacggtggtgaccangggctgtgagccccagtgtgcctggtcagagtggctggactacagctaccccatgccggggncctctggcggggactttgacacctactcnaacatccgtgcggccggaggggcngtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcnactccggggacgacctggatcctcacanagctgaccacaacagccactacgactgagtccactggatccacggccaccccgtcctccaccccagggaccacctggatcctcacagagctgaccacaacagccactacgactgcgtccactggatccacggccaccctgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatccccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttntctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgntgggccccgactggcacaccccccactgccagccccgcagccccggtgtctagcacacccacccccaccccatgcccaccacagctgctctgtgatctgatgctgagccaggtctttgctgagtgccacacccttctgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 73519 - DNA, 3990 bp, Homo sapiens
  misc_feature (950)..(950): n is a, c, g, or t
  misc_feature (1913)..(1913): n is a, c, g, or t
aattcgagctccgtacacgcacggagtgcaatggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatccccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttntctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgntgggccccgactggcacaccccccactgccagccccgcagccccggtgtctagcacacccacccccaccccatgcccaccacagctgctctgtgatctgatgctgagccaggtctttgctgagtgccacacccttctgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccagctgaatgaaacctgggtcaacagccatgtggacaactgcaccgtgtacctctgtgaggctgagggtggagtccatttgctgaccccacagcctgcatcctgcccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcctgccccggagcgtccaagtactcagcagaggcccaggccatgcagcaccagtgcacctgctgccaggagaggcgggtccacgaggagacggtgcccttgcactgtcctaacggctcagccatcctgcacacctacacccacgtggatgagtgtggctgcacgcccttctgtgtccctgcgcccatggctcccccacacacccgtggcttcccggcccaggaggccactgctgtctgagaacgttctgcctccatccccatgctctgtccacctggagccaggatgtgcattgtctgatcatgaaaaccttgggcctcctctgcggagccccccggcctgtgtgtggcaccccgcgctccgtgctcctgctgcccaccccgtgggtgaaaccggccccagaagggtgaggggccagcaggacccctttcgggagggcgccactcaggagtcctaccctgggagagcctgtggcccaccttggccttgcccctccctgatgtcactgggacgccctggaacaaactaagcatgtgcgggcctatgtgtccctgccacggccggagcgcccgcgcagcacggattccagctggccacgtccggccgctggggcagacaggctggtccaggcaaggccagctgctgccaggaagctgcgacaggcaaggcggccgcctgtccatgcctgctgcagggtaactcagggctgaggtcgcaacggccaggtcagagaggggtcagcatcccaaagccccctctgctcaacccagcccagttttgcaaataaaccctgagcattgagtacgtt

SEQ ID NO: 73520 - DNA, 6154 bp, Homo sapiens
  misc_feature (35)..(35): n is a, c, g, or t
  misc_feature (97)..(97): n is a, c, g, or t
  misc_feature (126)..(126): n is a, c, g, or t
  misc_feature (150)..(150): n is a, c, g, or t
  misc_feature (384)..(384): n is a, c, g, or t
  misc_feature (412)..(412): n is a, c, g, or t
  misc_feature (846)..(846): n is a, c, g, or t
  misc_feature (4147)..(4147): n is a, c, g, or t
  misc_feature (5110)..(5110): n is a, c, g, or t
cccacatcggcccccataaccacggtggtgaccangggctgtgagccccagtgtgcctggtcagagtggctggactacagctaccccatgccggggncctctggcggggactttgacacctactcnaacatccgtgcggccggaggggcngtctgtgagcagcccctgggcctcgagtgccgtgcccaggcccagcctggtgtccccctgcgggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccacgccctcctcnactccggggacgacctggatcctcacanagctgaccacaacagccactacgactgagtccactggatccacggccaccccgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactcccttctccagtccagggactgcaaccgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgcccacacctccacagtgcttaccacnacggccaccacaaccagggccaccggctctgtggccaccccctcttccaccccaggaacagctcacactaccaaagtgccgactaccacaaccacgggcttcacagtcaccccctcctccagcccagggacggcacgcacgcctccagtgtggatcagcacaaccaccacacccacaaccagtggctccacggtgaccccctcctccatcccggggaccacccacacccccacagtgctgaccaccaccaccacaactgtggccactggttctatggcaacaccctcctctagcacacagaccagtggtactcccccatcactgatcaccacggccactacgatcacggccaccggctccaccaccaacccctcctcaactccagggacaacacctatccccccagtgctgaccaccaccgccaccacacctgcagccaccagcagcacagtgactccctcctctgccctagggaccacccacacacccccagtgccgaacaccacggccaccacacacgggcgatccctgtcccccagcagtccccacacggtgcgcacagcctggacttcggccacctcaggcaccttgggcaccacccacatcacagagccttccacggggacttcccacaccccagcagcaaccaccggtaccacccagcactcgactccagccctgtccagccctcaccctacgcagcaggaccaccgagtcacccccttccccagggacgaccaccccgggccacaccacggccacctccaggaccacggccacggccacacccagcaagacccgcacctcgaccctgctgcccagcagccccacatcggcccccataaccacggtggtgaccacgggctgtgagccccagtgtgcctggtcagagtggctggactacagctaccccatgccggggccctctggcggggactttgacacctactccaacatccgtgcggccggaggggccgtctgtgagcagcccctgggcctcgagtgccgtgcccaggcccagcctggtgtccccctgggggagttgggccaggtcgtggaatgcagcctggactttggcctggtctgcaggaaccgtgagcaggtggggaagttcaagatgtgcttcaactatgaaatccgtgtgttctgctgcaactacggccactgccccagcaccccggccaccagctctacggccatgccctcctccactccggggacgacctggatcctcacagagctgaccacaacagccactacgactgcatccactggatccacggccaccccgtcctccaccccgggaacagctccccctcccaaagtgctgaccagcccggccaccacacccacagccaccagttccaaagccacttcctcctccagtccaaggactgcaaccacccttccagtgctgacaagcacagccaccaaatccacagctaccagcgttacacccatcccctcctccacccttgggaccaccgggaccctcccagaacagaccaccacacccgtggccaccatgtccacaatccacccctcctccactccggagaccacccacacctccacagtgctgaccacgaaggccaccacgacaagggccaccagttccacgtccaccccctcctccactccggggacgacctggatcctcacagagctgaccacagcagccactacaactgcagccactggccccacggccaccccgtcctccaccccagggaccacctggatcctcacagagctgaccacaacagccactacgactgcgtccactggatccacggccaccctgtcctccaccccagggaccacctggatcctcacagagccgagcactacagccaccgtgacggtgcccaccggatccacggccaccgcctcctccacccaggcaactgctggcaccccacatgtgagcaccacggccacgacacccacagtcaccagctccaaagccactccctcctccagtccagggactgcaactgcccttccagcactgagaagcacagccaccacacccacagctaccagctttacagccatcccctcctcctccctgggcaccacctggacccgcctatcacagaccaccacacccacggccaccatgtccacagccacaccctcctccactccagagactgtccacacctccacagtgcttaccgccacggccaccacaaccggggccaccggctctgtggccaccccctcctccaccccaggaacagctcacactaccaaagtgccgactaccacaaccacgggcttcacagccaccccctcctccagcccagggacggcactcacgcctccagtgtggatcagcacaaccaccacacccacaaccaccacacccacaaccagtggctccacggtgaccccctcctccatcccggggaccacccacaccgccagagtgctgaccaccaccaccacaactgtggccactggttctatggcaacaccctcctctagcacacagaccagtggtactcccccatcactgaccaccacggccactacgatcacggccaccggctccaccaccaacccctcctcaactccagggacaacacccatccccccagtgctgaccagcacggccaccacacccgcagccaccagctccaaagccacttcctcctccagtccaaggactgcaaccacccttccagtgctgacaagcacagccacaaaatccacagctaccagctttacacccatcccctcctccaccctgtggaccacgtggaccgtcccagcacagaccaccacacccatgtccaccatgtccacaatccacacctcctctactccagagaccacccacacctccacagtgctgaccaccacagccaccatgacaagggccaccaattccacggccacaccctcctccactctggggacgacccggatcctcactgagctgaccacaacagccactacaactgcagccactggatccacggccaccctgtcctccaccccagggaccacctggatcctcacagagccgagcactatagccaccgtgatggtgcccaccggttccacggccaccgcctcctccactctgggaacagctcacacccccaaagtggtgaccaccatggccactatgcccacagccactgcctccacggttcccagctcgtccaccgtggggaccacccgcacccctgcagtgctccccagcagcctgccaaccttcagcgtgtccactgtgtcctcctcagtcctcaccaccctgagacccactggcttccccagctcccacttntctactccctgcttctgcagggcatttggacagtttttctcgcccggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgaatgagacctggaccctggagaactgcacggtggccaggtgcgtgggtgacaaccgtgtcgtcctgctggacccaaagcctgtggccaacgtcacctgcgtgaacaagcacctgcccatcaaagtgtcggacccgagccagccctgtgacttccactatgagtgcgagtgcatctgcagcatgtggggcggctcccactattccacctttgacggcacctcttacaccttccggggcaactgcacctatgtcctcatgagagagatccatgcacgctttgggaatctcagcctctacctggacaaccactactgcacggcctctgccactgccgctgccgcccgctgcccccgcgccctcagcatccactacaagtccatggatatcgtcctcactgtcaccatggtgcatgggaaggaggagggcctgatcctgtttgaccaaattccggtgagcagcggtttcagcaagaacggcgtgcttgtgtctgtgctggggaccaccaccatgcgtgtggacattcctgccctgggcgtgagcgtcaccttcaatggccaagtcttccaggcccggctgccctacagcctcttccacaacaacaccgagggccagtgcggcacctgcaccaacaaccagagggacgactgtctccagcgggacggaaccactgccgccagttgcaaggacatggccaagacgtggctggtccccgacagcagaaaggatggctgntgggccccgactggcacaccccccactgccagccccgcagccccggtgtctagcacacccacccccaccccatgcccaccacagctgctctgtgatctgatgctgagccaggtctttgctgagtgccacacccttctgcccccgggcccattcttcaacgcctgcatcagcgaccactgcaggggccgccttgaggtgccctgccagagcctggaggcttacgcagagctctgccgcgcccggggagtgtgcagtgactggcgaggtgcaaccggtggcctgtgcgacctcacctgcccacccaccaaagtgtacaagccatgcggccccatacagcctgccacctgcaactctaggaaccagagcccacagctggaggggatggcggagggctgcttctgccctgaggaccagatcctcttcaacgcacacatgggcatctgcgtgcaggcctgcccctgcgtgggacccgatgggtttcctaaatttcccggggagcggtgggtcagcaactgccagtcctgcgtgtgtgacgagggttcagtgtcggtgcagtgcaagcccctgccctgtgacgcccagggtcagcccccgccgtgcaaccgtcccggcttcgtaaccgtgaccaggccccgggccgagaacccctgctgccccgagacggtgtgcgtgtgcaacacaaccacctgcccccagagcctgcctgtgtgcccgccagggcaggagtccatctgcacccaggaggagggcgactgctgtcccaccttccgctgcagacctcagctgtgttcgtacaatggcaccttctacggggttggtgcaaccttcccaggcgcccttccctgccacatgtgtacctgcctctctggggacacccaggacccaacggtgcaatgtcaggaggatgcctgcaacaatactacctgtccccagggctttgagtacaagagagtggccgggcagtgctgtggggagtgcgtccagaccgcctgcctcacgcccgatggccagccagtccaggtaacagcagaggcatgtgggggc

SEQ ID NO: 73521 - DNA, 296 bp, Homo sapiens
caggcagccaggttaaggcagtggtaagggcttgtggaaatcctcttctacctgttttttcttgggagatggggagattttgtgaggaagagaaggtatgaagcagtcaccctagagaatgggcagatgactgtgctagggaaatagagtggcattgctgggcagcaccaaaggcccacttgaggttcatggtataaactgatgagactaatgagcctggtcgtgtggttttctaccgcccatttagttgcctgggtaaaggtggagagctactgaatttaatatttatccctaag

SEQ ID NO: 73522 - DNA, 7499 bp, Homo sapiens
atgcccagtgatgccaaagacagtgttaatggtgaccttttgttaaattggacaagtcttaaaaatattttaagtggtcttaatgcttcttttcctcttcacaacaatactggctcaagcacagtcactacttcaaaatccatcaaagacccaagactgatgaggagagaagaaagtatgggagaacagagtagtactgcaggcttaaatgaggttttgcaatttgagaagagttcagataatgttaattcagaaataaaatcgacaccatctaattctgcctcctcctcagaagttgtccctggtgatcgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttctttacaaaatcaaaaactgactataatgataccaaaaataaaaaggaggtagaatcaagaattagcaaaaggaagctacatatatcttccagggatcagaacataccacataaagatttaagacgacataaaatttatgggagaaagaggaggctaaccagtcaagactcatctgagtgtttctcttcattatcccaaggacgaattaaaacattttcacagtcagaaaagcacattaagagtgtcctaaatatcctaagtgatgaagcatctttatgtaaaagcaaatgtctttccagaaaactagacaaagcagttgttcacttaaaaaaagctcatagaagagttcacacatctttgcagcttataactaaagtaggagaagaaagaaagggcccattaccaaaatcatatgcagtaatatgcaataatttctgggaaagttgtgaccttcaaggttatagttctgtgtctcaaagaaaatattattctactaagcatttttcgtcaaaaagaaaatatgacaaacggagaaagaaaagagctccaaaagctgatatttctaaatcattaacccatgtgtcaaagcacaagtcttataaaacaagtggagagaaaaaatgcctttctaggaaaagtatggctagcagtgtctcaaaaagtcaccccaccaccagtcacatgggagaattttgtaatcaagaacatcctgaatcacagttgcctgtatcctccacatcccaaagtacaagtcagtcagtttattataatagcagtgtaagcaatccaagtttatcagaagaacatcagcccttttctggaaaaactgcatatctgttttccccagaccactcagatgagaaactaatagaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaagcattattacaggaaacttccttatgggcccattaaacctaactttgatagcaagtaaaaagtacagtattcctcaggtatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcagaaggaagattttacagctgaagagaaaagaaaaaatgaatattcatattgtaaaacctggggaaaataacaataaatttagtatttctacgatgttgcccccagtatcagagtgcataaacaaaaacatctcaaattcctctaaaaaacgaccgagcactgtagacaaatgtgaagactctcaggaacaacagcaagatactactgtttccagttgtaaaaagctaaaggtagacatgaaagatgtcacaaaaatcaacagagaaaaggcaacattcaagcatccaaggactacaggatctcatcccaaaagcgaaaacaaaatagtaccaagttcatgtgacagtctgaaaagaaatcatttaacgccaaaaaaggttgaaatgcaaagatcactacctggctcacttttacccttagagaacccaaaagacacttgcgcatcaaagtcggaaagcaaaatagacttaactgtttcatctgatcacttcagtggacaacaggaaaatttaaatagcatgaagaaaagaaatgtgaacttcagtgctgctgaaacaaaaagtgataagaaagattgtgctgcttttgcaatttgtgaccaaaaaagtgtacatggcacattttcaccagaccatgggacgcttttgcagaaatttcttaaaaattccccagatcccacccaaaaatcctgcctttctgatataaacccagaaactgatgtttctcttgtgcctgatgcgtcggtgctctcaaagccaattttctgttttgtgaaagatgtccatcctgatctagaaatgaatgacacagtctttgaacttcaagataatgatatagtaaattcatctattaaaaattcctcatgcatgacttctccagaacccatctgtatccagaacaaaattcctactctgcagataaacaaactacagcctacagaaactgagtcagaggacaaatacatgaaggatacattgaatcccaatactgtgcatacttttggagcatctgggcatataacccttaatgtgaatcaaggagcagagtactctctttctgaacaacagaatgacaaaaattcaaaagtcctaatgcagaatgctgccacatattggaatgaacttccacagtctgcatgtaacccaacatataattcttctgagcatttatttggaacttcatatccatactctgcttggtgtgtttatcagtacagcaacagcaatggcaatgccattacccagacataccaagggataacatcatatgaagtacagccatctccttctgggctgttgaccacagttgcaagtactgcccagggcacacattctaatcttctgtactctcaatattttacttattttgcgggggagccacaagcaaatggctttgtgccagtgaatgggtattttcaatctcaaatacctgcttctaattttcggcagccaattttttcacaatatgcttctcatcagccattaccacaagctacatacccttaccttcctaatcgatttgtgcctccagaagttccttgggtttatgctccatggcaccaagaatcctttcatccaggacactgaaaatagtcttctgtctattgaaataagacataacaagtttttccaaatattttttacttatatattttttaacatttagcgatttttaatgtttgtaaatgtggtaggaaatataaatcatatggtcctttgtaaaatatacaaataatctaacacatatcatataggacatcaatttctaacatctgatataccagaattatttccatgcaattataaggggagggtaatatgatcaaagttaagcaatagtggtaaaatctttaaaactagattcttgcttctgatatgtttcaatacattgttgatggcattgtgccatttgagctgaaagcaggattttttttcattagtcatcaaaccaagaattttataattcttgacactttattatataatttacaattctatgccagatatggcaaatttcttcaatttcagtattttatagtttctacttgtaaaatatttttaataagaaaaattggtttgcataatctcagtgtttccttgagtagagatgttttaaatgtttatgttggaagcaattgtagttaattatattggcaatgaagcactttcaatgcctttttctacaagagccatttccagaagattattttgtttttggatttcacaatttaaatagttattttaatgattttctagcaaataatagagaataatgtttatgcttatgcagttagtctttattacagtaatttaaacaatgtggcacaaacatagttttttcatgctcttgtcatagacttttctttttaaccttctgcaaaagtaaaaactctcttagtaataatcatcatagggcaacaggatatagtatgtaactgcagtcttgagctgtctcttttcatgtattacctttcttgctcaacagctattcctgttttctgtaagatcctagtcagacagagccctcacaactggatagacctttctcaagggttagccctaaaatgtgacaagagaattggtttggctgaatcacaacaaataactagcaaagcttcagtgcttttgcaaactttttatgtaagcaaactttttgtgttatctggcacaggcctttgaaaagactataattctactttgtttaatgtagagtaactaatttttcaatttagaaagacagtgagaatccccaggataagcctctttatactcacttaaaccaactgggatggaattcagaatacctaagctgcttctttaacatagagatctttaaaaagggaaggtcaagcaaagaactgtaaccgaaagaagtaagagatttgaaaagacgatagagttaaaacaatatttaaaaaacatttctatttggtccatgcagttttatttgaaaatagtctgtcaaaatcagaactcctgaacaactttgaaagcagtaatattaactggtattcaaaaatgaataacagccaaaaatgaataacagccatttgatttatgtttccctcagtcatttggtttatgtttggttatggcaagatgttacagcatttatagttaatactactactaatatgtaaaccaaaagttaaatattctagttaaggattgtttctttaaacaactttcagattctgttgacattgtctttgtggtatttttatttcatgggttttaatttctcttaaagacttacctaaatattcagttacatttttaaaaaatctgtacgtgacagaatattaaaacatggaatatttttgcttc

SEQ ID NO: 73523 - DNA, 10110 bp, Homo sapiens
atgcccagtgatgccaaagacagtgttaatggtgaccttttgttaaattggacaagtcttaaaaatattttaagtggtcttaatgcttcttttcctcttcacaacaatactggctcaagcacagtcactacttcaaaatccatcaaagacccaagactgatgaggagagaagaaagtatgggagaacagagtagtactgcaggcttaaatgaggttttgcaatttgagaagagttcagataatgttaattcagaaataaaatcgacaccatctaattctgcctcctcctcagaagttgtccctggtgatcgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttctttacaaaatcaaaaactgactataatgataccaaaaataaaaaggaggtagaatcaagaattagcaaaaggaagctacatatatcttccagggatcagaacataccacataaagatttaagacgacataaaatttatgggagaaagaggaggctaaccagtcaagactcatctgagtgtttctcttcattatcccaaggacgaattaaaacattttcacagtcagaaaagcacattaagagtgtcctaaatatcctaagtgatgaagcatctttatgtaaaagcaaatgtctttccagaaaactagacaaagcagttgttcacttaaaaaaagctcatagaagagttcacacatctttgcagcttataactaaagtaggagaagaaagaaagggcccattaccaaaatcatatgcagtaatatgcaataatttctgggaaagttgtgaccttcaaggttatagttctgtgtctcaaagaaaatattattctactaagcatttttcgtcaaaaagaaaatatgacaaacggagaaagaaaagagctccaaaagctgatatttctaaatcattaacccatgtgtcaaagcacaagtcttataaaacaagtggagagaaaaaatgcctttctaggaaaagtatggctagcagtgtctcaaaaagtcaccccaccaccagtcacatgggagaattttgtaatcaagaacatcctgaatcacagttgcctgtatcctccacatcccaaagtacaagtcagtcagtttattataatagcagtgtaagcaatccaagtttatcagaagaacatcagcccttttctggaaaaactgcatatctgttttccccagaccactcagatgagaaactaatagaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaagcattattacaggaaacttccttatgggcccattaaacctaactttgatagcaagtaaaaagtacagtattcctcaggtatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcaggtaattgcctccatacagatgggaatgaaacaaatgtcactgagaattatgagttggatgtagcatcaggaactgaagaagataaaagttatggggaaaatatagtggaattatcttccagtgatagttctctgcttttaagagataatgtaaaaggctcctcttcagaaacatgtattgtgaagaaagacactgaggacagaataacgtggaaagttaaacaagcggaaaaagcaaaagattctgtttacaaaagaagcatgactgaaggatcaactgttaatactgagtacaaaaatcaaaagaatcagatctcagaagaatcctgcttaaatgagaaaattattacaactaacttgattgattcccatctgagcactaaaaatactaccactgagtcagtccctttgaagaacacagtttctaatccgcttaacaaaagagagaagaagggggaaattaaagttagtaaagactcgcagtctgacttgacattacattcagaaatagcctatatttccaaaccaggaattctaggagttaatcatacgcctattttacctgcccactctgaaacctgtaaagtccctactcttctgaagaaacctgcgtcatacgtgagtgattttaaagaaaaacattgctcagctaatcatacggcccttatagctaatctatctcaaattttgcagagggcagatgaagcatcatctttgcagattctacaggaagaaactaaggtttgtctaaatattctccctttatttgtggaagcttttgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatgatctcctcaaaggttaattttattaagaacaacgaggcagtacgtgttaaaatatctctttatggtctggaacatatcttttttgatgctgcaaaaaatcttgtttggaaagagagaacacaatccttcagcaaaaaatactcacaaaagaaggacgaagaaaggctactcagagtgaataaatgtgccttttctaagttgcagaagatatatgatactttgtctaaagatttaaacaatgaaccaatttcccctattgggcttgaggaggatactataattgcttccagaaagtcagatcatccaataaacgaagcaacaattagcatagaaaattctaaatttaacagtaatttgcttgcacacccagatatttgttgtattagtgagatattggatcaggctgaatttgcagaccttaaaaaattacaggatctcaccttgagatgtacagatcacttagaaattttaaaaaaatactttcagatgctacaagataataacatggataatatttttatcacagaagaaaatgttttagacgtggtgataaaccacagccatgaggctatcattttaaagcctgaagctattgaaatgtatattgaaatcgtcatggtctcagaaacaattcactttcttaaaaactcaatagcaaagaaactagacaaacagaggtttcgaggtatgctttggtttgatttgtcacttcttcctgagctggttcagtgccaagaaaaaatggcttctttttcatttcttaaagataactcaacagatgtttgcctttggaaagtgatagagactgctgtttccgaacttaagaaagatctggatattatctgcaaatataatgaagctgttaattgctcatatgctattcatttgctctcaagagaacttcaagaactttcagaaataaaaaagcttctgaagaagtccaagtattttatttccacatatattgactttgtgccatatatagcatccataaattatggaagcactgtgacagagttagaatacaactacaatcaattttctacactgctgaagaatgtaatgtctgcccctaggaaagatttaggaaaaatggcccacattaggaaagtcatgaaaacgattgaacatatgaagatgatatgtactaaaaatgctgaactaaccatttcctttttcctatgccaaatgctgtataacagaaggaagattttacagctgaagagaaaagaaaaaatgaatattcatattgtaaaacctggggaaaataacaataaatttagtatttctacgatgttgcccccagtatcagagtgcataaacaaaaacatctcaaattcctctaaaaaacgaccgagcactgtagacaaatgtgaagactctcaggaacaacagcaagatactactgtttccagttgtaaaaagctaaaggtagacatgaaagatgtcacaaaaatcaacagagaaaaggcaacattcaagcatccaaggactacaggatctcatcccaaaagcgaaaacaaaatagtaccaagttcatgtgacagtctgaaaagaaatcatttaacgccaaaaaaggttgaaatgcaaagatcactacctggctcacttttacccttagagaacccaaaagacacttgcgcatcaaagtcggaaagcaaaatagacttaactgtttcatctgatcacttcagtggacaacaggaaaatttaaatagcatgaagaaaagaaatgtgaacttcagtgctgctgaaacaaaaagtgataagaaagattgtgctgcttttgcaatttgtgaccaaaaaagtgtacatggcacattttcaccagaccatgggacgcttttgcagaaatttcttaaaaattccccagatcccacccaaaaatcctgcctttctgatataaacccagaaactgatgtttctcttgtgcctgatgcgtcggtgctctcaaagccaattttctgttttgtgaaagatgtccatcctgatctagaaatgaatgacacagtctttgaacttcaagataatgatatagtaaattcatctattaaaaattcctcatgcatgacttctccagaacccatctgtatccagaacaaaattcctactctgcagataaacaaactacagcctacagaaactgagtcagaggacaaatacatgaaggatacattgaatcccaatactgtgcatacttttggagcatctgggcatataacccttaatgtgaatcaaggagcagagtactctctttctgaacaacagaatgacaaaaattcaaaagtcctaatgcagaatgctgccacatattggaatgaacttccacagtctgcatgtaacccaacatataattcttctgagcatttatttggaacttcatatccatactctgcttggtgtgtttatcagtacagcaacagcaatggcaatgccattacccagacataccaagggataacatcatatgaagtacagccatctccttctgggctgttgaccacagttgcaagtactgcccagggcacacattctaatcttctgtactctcaatattttacttattttgcgggggagccacaagcaaatggctttgtgccagtgaatgggtattttcaatctcaaatacctgcttctaattttcggcagccaattttttcacaatatgcttctcatcagccattaccacaagctacatacccttaccttcctaatcgatttgtgcctccagaagttccttgggtttatgctccatggcaccaagaatcctttcatccaggacactgaaaatagtcttctgtctattgaaataagacataacaagtttttccaaatattttttacttatatattttttaacatttagcgatttttaatgtttgtaaatgtggtaggaaatataaatcatatggtcctttgtaaaatatacaaataatctaacacatatcatataggacatcaatttctaacatctgatataccagaattatttccatgcaattataaggggagggtaatatgatcaaagttaagcaatagtggtaaaatctttaaaactagattcttgcttctgatatgtttcaatacattgttgatggcattgtgccatttgagctgaaagcaggattttttttcattagtcatcaaaccaagaattttataattcttgacactttattatataatttacaattctatgccagatatggcaaatttcttcaatttcagtattttatagtttctacttgtaaaatatttttaataagaaaaattggtttgcataatctcagtgtttccttgagtagagatgttttaaatgtttatgttggaagcaattgtagttaattatattggcaatgaagcactttcaatgcctttttctacaagagccatttccagaagattattttgtttttggatttcacaatttaaatagttattttaatgattttctagcaaataatagagaataatgtttatgcttatgcagttagtctttattacagtaatttaaacaatgtggcacaaacatagttttttcatgctcttgtcatagacttttctttttaaccttctgcaaaagtaaaaactctcttagtaataatcatcatagggcaacaggatatagtatgtaactgcagtcttgagctgtctcttttcatgtattacctttcttgctcaacagctattcctgttttctgtaagatcctagtcagacagagccctcacaactggatagacctttctcaagggttagccctaaaatgtgacaagagaattggtttggctgaatcacaacaaataactagcaaagcttcagtgcttttgcaaactttttatgtaagcaaactttttgtgttatctggcacaggcctttgaaaagactataattctactttgtttaatgtagagtaactaatttttcaatttagaaagacagtgagaatccccaggataagcctctttatactcacttaaaccaactgggatggaattcagaatacctaagctgcttctttaacatagagatctttaaaaagggaaggtcaagcaaagaactgtaaccgaaagaagtaagagatttgaaaagacgatagagttaaaacaatatttaaaaaacatttctatttggtccatgcagttttatttgaaaatagtctgtcaaaatcagaactcctgaacaactttgaaagcagtaatattaactggtattcaaaaatgaataacagccaaaaatgaataacagccatttgatttatgtttccctcagtcatttggtttatgtttggttatggcaagatgttacagcatttatagttaatactactactaatatgtaaaccaaaagttaaatattctagttaaggattgtttctttaaacaactttcagattctgttgacattgtctttgtggtatttttatttcatgggttttaatttctcttaaagacttacctaaatattcagttacatttttaaaaaatctgtacgtgacagaatattaaaacatggaatatttttgcttc

SEQ ID NO: 73524 - DNA, 377 bp, Homo sapiens
ggttgggttgggataaatatgaacccaaacaggagcttgaatagatgagactgagacccactgtcgctcaaagaaaggtctaggagctggacacctagatgctgtcttcaaacattcattcaaaaacctttcccaggcacctactacgtccagtcacttcttttgaagtcctggaggttcagagatgaagaggatacagctattacaattctggagtttcctttgaagacaaagagtagtgaacagataagcacactgcaatgagttatgtgggctgatggagggaggcccagctgtggccagagtctagaggaagggcactcactgggcttcagagaaggaggttcaatgttggtttctcaggtgacaatatcctt

SEQ ID NO: 73525 - DNA, 369 bp, Homo sapiens
tcacaaatttagaactggagagctgatcgactgaaaactcctgtttcacatgcctaataaaattctttcattcaaaggaaaaaaaaatcataactaccagcgtaaaaagaaaacatctaaatcatgaaacaattatcaaagaaacaaaaattctcagaacatcgcaactgtaatatatagaaattcccatcaaataactcaggtgaaaaaaaaaaaaaatgggacaagcaccgttggctcaggcctgtaatcccagcacttcgagaagctgaggcgcaaggactgcctgaggccaggagttggagactagcctgagcaacatggtgagacccttgactctacaaaaataaaacaaaaaattagccaggt

SEQ ID NO: 73526 - DNA, 495 bp, Homo sapiens
ctatctcataggctagaaggaggcagccgatccagttaatgcccctgtttccacaaggactcacagttctagagcattcttcctggccccacattcagctagtgacactgctaactactctcccagtcctcacacattctgatcatgtgccccccagagtaaaaacagacaaataactcatttaacttgcccgagatatttttacttattgatatgcttaatgatataccagtatactaatgtatttctaaaatacacattcacgaaataaatctgaataggtgagataaaaataagtagaaaaagtcattttagattttttcctcatatctcaaattattgtccttcatgcatactttgggaggtatcaattcgggccaggcacagtggctcatgcctgtaattccagcactttgggagactgaggcgggcggatcacctgaggtcaggagttcgagaccagcctggccaacatggtgaaaccccatctctact

SEQ ID NO: 73527 - DNA, 354 bp, Homo sapiens
gaactcctgagctcaagtcatcttcccacctcagcctccttagtagctgggattataggcagaggccttgttttcatgagcctctaaattggatcttcttatttgatgtgatacccagtgacacagaattgttcaatttgaggaaatataaattcctcccctctcaaataagagctttggagttgcttttctctcagaatgggattttagagctttcaaaaatgtttagagaattttatgacagatttgtttcacactagacctataacaggttattttacattgacttctggtgatggagacatttgtggttgaaatgcttctcgtgtaattttctacatgagcttttcttta

SEQ ID NO: 73528 - DNA, 447 bp, Homo sapiens
cagttcaggtcatatatatatatatatacacacacatacatacatctttctgatttactcctacctgatctttcagttactaagaaaagtgtcttaaagtctgcaattataattgtctcttaacatttccaactataatgcagatatgtctatttttcctttcagttctatatatttttacctcatgtattttttttcttgagatggagtctcgctctgttgcccaggctggagtgcagtggtgcgatctggactcactgtaacttccacctcctgagttcaagccattcttctgccttagccttccaagtagctgggattacaggcgtgcactaccgcacctggctgatttttgtattgttaatagagacaggacttcatcatgttggtatggctggccttgaattcctgaccttgggtgatctgcctgcctcagcctcccaaagt

SEQ ID NO: 73529 - DNA, 1117 bp, Homo sapiens
aaggtatgaagaaaaggtgattgagaactaattaccaagggaaactggcaagacaactggatgcgtgtaatccgaatggtcataatgagacaacagctaacactgaatgcttgctgtgtgtttggcactctgctagacgttttactggtattaaccgatttaatcctcacaataacgaagtatgtactactataattgccagtttacagacgagaaaactaaggcacaaagtttaacttgccccaagcgacagagtggataagtaaaagggcgaggactgggaccctggtactctgaatgaagagcctgtgcctccctctctcccctaacagttttaaggagatacaatttacctgccacaaaatttacccattttaggtttatacttagatggttgttcagtaagtttatagagttgtgcaactatcacaaccaatgttagaacaactcaaaaaaaaaaaaatcttattccagtttgcaattaagccccatttccatttccacacagcaactgatcggctttctgtccttcaggtttgccatttctgaacatttcctataaatggaatcagacatggtcttttgtgtctggcttctttcactcagtaatgtttctgaagttcctccctgtagtggcatctatcagtaattgctttcctttttattgctgggctgaatgctgttccattgtatggctgtgtcagattttgtttgttcattcaccagttgatagacatgtagattgttttcatgctgctgtgaccatttgtgtacaagtgtttgtgcagacatatgtttaactttttaggaaattgccagactgttttccaaagaagctgcaccattttacatttgcaccagcaatgtaggagggttctgatatctccacgtcctcaccaacacttgtgattatgtgtcttttaaaattatagccatccttgtggatgtgaagtggtaactcattgtggctttgatttacatttccttgatagctaatgatgagcatttttcatgtgcttatgggccgtttatatacctttggtgaaatgtctatttaaatcttttgctcacttttcagttgggttttttttcttattaaatagtaagagttcttaat

SEQ ID NO: 73530 - DNA, 368 bp, Homo sapiens
tgtagggtacaagattaacagcaataggaatagtttgccattttccttaattgtggagagaaagagctactgaaatgtctgtgactgtaagctttccttggcctagtgctgttagcagagcactgttggctcatgagtgaacatactcatttttaaatgagtctaaaatgaatacatcagtagttggtgcctttaaggccactgactaaatgttgtggcatttttatttgatagtctcaatctgcagtatccagtatgggtccccactactcacatgtggcttttaaaattcggcattaggttaaaaataaaacttccatttctcagtcacaccagtcacattttaagcgcttggtagtcacatgtgg

SEQ ID NO: 73531 - DNA, 213 bp, Homo sapiens
cgcaacaccacaaaagcaggaagaaagacagttaggatgcgagcacatgtgtgaaggtggagtgtgaagagtagaacagtcagaatccctgtagctccagatacgagagtgcagccatgcacagcctcttccacaagcctgtttggtgctcacaggaaaaactgggtgggaccagcctggtcaacagtgtgagaccccatctctattaaaaat

SEQ ID NO: 73532 - DNA, 370 bp, Homo sapiens
cgtcgacatttcattgatggggggagaggtttaggaaatggctgggcgacagctttgtgtagaatataagcatgattgcatgacgtgaccttcaagctctgaaattctagaagtatttctctaaagttatgaattgtgcagcacttctagaggcatctgagagtagatgtgttagaaatgaagggcctcaaggcactgtctcccagcagcttgcacaaggtgacacccatagggtacccaagccacacagatcacactcatccttcttccacagtacaccattctgcactctgaacacagattcttcctcatcacaaaaataacataaaaaagaatctgaggcacacgcaatgtcaacctgagcttataa

SEQ ID NO: 73533 - DNA, 577 bp, Homo sapiens
gatcgctcatatatgcaaaagtactctgaaatcgcaagactgatataaagatatatgcttctatcaagtgcttataacagaaatgatttcattgctatacacacattcacacacatacaataatatgcaaaatttcttgcaaaacttgcaaacaaagcaggtaaagacataaataatcagtaattaagaattcaccggagaggacagatgagagattatgctgagtcaagaagctaaaatgcatatataaaatttatgcatgtgtggggtcattgcacctgtgccctcagtgaaccattcaatcaagaacaaactttctgttataagatgaaaaagtcctggagatcttatgtacattaaggtgactgtagttaatagtaaagcattgtatacttaaaagttgcttaaagagtagatcttaattgttctcactatagaataaaaggtaactatgaagtgatagaggcattagcttgttacattttataatccatgcatatatcaaaatatcacgtgtgtaccttaaatgtatacaattttcatttgtcaattatacctaaataaaactgaggaaaat

SEQ ID NO: 73534 - DNA, 348 bp, Homo sapiens
cacaggtgtcttggagcctaagttacaattgattaaataaactctttaggcaattatgaatcactgcagattctaggtatttgtgagcctgatgggagagaggctgggtgccgaagacctttctggatctctagcaagtggaaaaataaggaagactgcctgagagcttcttgaggcctgaggctgagggtatgacagcacccgtgatgcaaatgctaatatgaactagaaataacccaggctgagtcagagtcaaccttcccatacatctacagtttttcttctctcaaatcatggtgcaccactggggcttcattgcaatacattggttagttctatttttagtgc

SEQ ID NO: 73535 - DNA, 269 bp, Homo sapiens
cattcccagctctatgagcctttttgctcattcctttttttgtcttacaaggaaaatcaggtactcacacttcgccaagcattggccgttgttgtctcagggcttctcaaggccatgccaccagtgaatttgcccattccctatggtcttttacagggcattaaagccaatgtcctaagaaagtacccacaagtcaacaaattcagtcatacatcctgtctgtccttaatcaataccctttgaaattcaatcccaggagttctcttctg

SEQ ID NO: 73536 - DNA, 466 bp, Homo sapiens
aaattgagtacccaataaatgtgcgtcgagcagaactacacgagatggagaacaggggtttaggggtatgggggagagtcagcaattactggtgtcctccctccctcccccagctctgctcctacagatccaggacgcctagcgagggtaggaacctcttctgtgcttccgcaacgctctgaactgcacggcactgagcgcatctaattaaagtgatggtttcattagatagcaacacagcgagaccccgtttctacaaaaaataaaaataaaaaataaaagattagctgggcgtggttgctcgcgcctctagtcccagctacttgggtggaggctgaggaagaaggatcgcttgagcctaagagttcgaggttgctgtgagctatgatcgcgccactggactccagcctgggcgacagagcaagatcctctgtctaaaataaaaataaaaataaaatgatggttt

SEQ ID NO: 73537 - DNA, 330 bp, Homo sapiens
gcagatctctggtttctcttcataacgaataaatctttcgccttttactaaagatttccgtggagaaaaacaactatgagtttatggttaaattttttgaagtcttgcctaggcaaggctgaatgttctgttactaaagagagacgtgtgggtggggtgtttcatgctttgggaggttggggtagctccacaaatgtcacccaggttgtagcggagtggtgtggtcgcggctcactacaacctccatctcccatgctcaagcaatcctcccacctcagcctcataagcctgtctaattttgtgtactttttgtagtgcccggcctactgt

SEQ ID NO: 73538 - DNA, 464 bp, Homo sapiens
ttttttaactaattacaaaataaaattaggatttgtttacaaaatgtagagcattttgctcctcagcatatattttatagcttcttcaaattaggagaaaggatgatgataatctacccaaagagaaacatttgcaatctaaagcaaagctaataaaattggcctctcaacattttctaaaaatgttttcagtggtaacagtgccaacagcacgccaagagcatctatacttccaagcaatctaccaatgtccatggatggaatatgtaagagttcaatcagtattcaaaaaggaatcaaccctctccctattaaaaaataacaatcatcatgattagcacatgatctctgtgaaattcaatcacaaagatttgaaaagccatctagcagaaataacctgagatttgaaaagtcatctagcaaaaataaccaaatgaaagcataaatcatcatatcagaagtta

SEQ ID NO: 73539 - DNA, 155 bp, Homo sapiens
ttttactgccagagatgcaactgtctttattgcagtaaataacaagttcagagctttagtaaagaatacatataggccgggcatagtggctcacgcctgtaatcccagcactttgggaggccgaggtgggcggatcacgaggtcaggagatcgag

SEQ ID NO: 73540 - DNA, 391 bp, Homo sapiens
tgttgccaccaaggtgtcctgcatgatgtctggacaccggaccagcggcctctgacaggaagagtttgtgttgtgacagtgcatgccttggaatggttgttcctttttaaaaaaaatctgacaagttgctctagtaacccaaagaagtgaaggagaaaccagctaccccactggacagatactgatttgtgcagaatccgtttcaatgcctcatgaaacaataaaaccacgaacatcttccttaaaaaaataaagaccacctcaccttccccttccccaggtttagctttgtacaaaagactgaggaagccgctgactctgccgggttctccctgctctgccactccaggccttctccagacctggcctgcagagaagggcacgggggaca

SEQ ID NO: 73541 - DNA, 250 bp, Homo sapiens
gataataggcaataataactagtgtttattaaatatctactgtgtgttagaaatttgtctaggctccaaagagcctatatattaacatatacatatatatatatacacacacacacacacgtgtgtgtgtgtatatatatgtgtgtgtgtgtgtgtgtgtgtgtgtgtgtgtgtgtgtgtattcatataaaatatatatctctctatccaagctactttctaagcacctcaagctttcactccaaaagag

SEQ ID NO: 73542 - DNA, 742 bp, Homo sapiens
tgggttgtctctttatcaacagtttcctttgacgcacaaaagcctttaattttgatgaagtccagcttatccttcttttgttgttcatgcttttggtgtcatatctaagacagcattgccaaattcagtatcatggacattttcatctatgctttcttctaggagttttatagttttagctcttaaacataggccttcaatccatttttagttaatttttgtatacggtgtaaggtaaggatcctagtttattaatttgcatgtggctagtcagttgtcccagcaccatttgttgaagagactgttctttccatcacccattgattttgaaactttctagtggatagcattttagttaattattatatattgctttttgttgtgatttgatacatgtatgtcttatttctacaagtagagaggactccattcaagggaggggactggcttctgtcatgtttctggtattttatgtaagggctaaaatggttcccagagtgagcaaaaaggaatcaaagaggacgcaagcccttgacccaagaaaatcagagtattttatttaaagaacaacttttagttggttggtttttttttgttgttgttttttttttgaaatggagtctcactctgtcactcaggctgggacaggagaatggcttgaacccgggagttggaaggtgcagtgagctgagattgcaccactgcactccagcctgggtgacagagcaaggctccgtctcaa

SEQ ID NO: 73543 - DNA, 626 bp, Homo sapiens
ggttctgttgggaaggcgtatttggttttgaaatgtgagaaggacatgagattttggaggggccaggggtagaatgatatggtttgactctgtgtctccacccaaatctcatctccaattgtaatccccatgtgtcaagggagggacctgatgggaggtgactgaatcataggggcagtttcccccatgctgtttgcatgatagtgagggagttctcatgagatctggttttttggtaagtgtctggggcttcccccttttccctctctctcctactgccttgtgaagaaggtacttgcttctcctttgccttctgccatgattgtaagtttcctgaggtctccccagccattcagaactgtgagtcaattaaacctcttcctgcctattctcaggcagttctttatagcagtatgaaaatggactactacagaaagtgtttaactttaaactcagtagtatccaaagaagtaatgaaaatggagaaacgaacaacaaaatcatagtacaatatggtgtatgtactaggacaggaagagcccttttaagaagagatctatgtatttccatttgtttatctctgaaagaaagcaactttgccttgtattctgaaaaagaaaggaata

SEQ ID NO: 73544 - DNA, 250 bp, Homo sapiens
aagatttgaaatcttttggttgggggacaatgtgacttttcaaggaagaaaacagatttctagaattcggtcaatttatatatctagctagccatttggatcaaaacaccaaacacattctcatctgcagatactaaaagctagctagttatcaaagattccattcattatgagtaataaaagctaaagctaattaaaatattcccaacatcatctaaaatgacacgattctctgcatgaatccccaaaa

SEQ ID NO: 73545 - DNA, 312 bp, Homo sapiens
attaagaggaggtgattgtattattcctcttttcagataatggagagagagaagagaacagcagtagccgttgccagaaatattgagcaaggcggatttattagatgaagatatcaaaatactttccattgaggaaacaggttggaggtgggaggctgtaaccatgcttgattttgtaccaccctaacctttgcttgatccaggttccagtccaatatgcaccattcagcctggttgcagcatgttaagcagccctggaggcagcagatgagggatcctatgaagcaactttcagacattcagaaccaagac

SEQ ID NO: 73546 - DNA, 354 bp, Homo sapiens
cacagtggtgacgattttaatttctggtgtgaatctcaagtccacttttaggaagcaggagataaatccccatcaagaaaaatcattcattttctttgcatctctctctagcatatttgatatttgattgaaattttaacacctgaaacaactttttgttttgttttctctttggcaagtccatccttacaggtgtagttagatgggttagacagggatactaataattctcctcctccctcttcccatcttggatagaaaaatattgatctgatattatgtgaggctttctgaatgagagtgaattggacagtgaaaagcataagaaaaaataaagtaactaactcctttaaa

SEQ ID NO: 73547 - DNA, 416 bp, Homo sapiens
tttttttttttggagacggagtctcacgctgtactccagcctgggcgacagagtaagactctgtctcaaaaacaaacaacaaaaaaattagccaggtgtggtggggagagaggggaagaatagggacaaaagggaatacataaataaacacaaaggagaaaaggccctgcatggaccacttacatgtgtcatgaactcaggagtgttcatggtgggactacatggtgcacctgtagtcccagcttcttggggtggggggctgaggtgggaggatcgcttgggcccaggaggtcgaggctgcagtgagccctgattgtaccacagcactctggcctgggaaacagattgagacagggtctcaatctgtttccgtcgcaccggccgcaaatttagtagtagtagtagtagtagtaggc

SEQ ID NO: 73548 - DNA, 386 bp, Homo sapiens
atgaaatgaggtaattttctgggcccttggtacaatgcctgagatgtcatatatactcagctaattataagtgacattttgttctagaatccagtagctcaacttttagtccattgtgctgaacacaaatctatagatccttaaattgtatacttttattaatttaattttaaagagccagaaaaattgactacattggaaacattccagtccaccaacatattgagtagaaagaaggacaaaggccatattctctttcagatgctacaaattgtgtatattttcagtaagctgtgtctgcttaaggaggcattactgcattcggatagataaactcaaataaaaaggcctgagtgaagaggctctactgggtttagcgttttttt

SEQ ID NO: 73549 - DNA, 697 bp, Homo sapiens
cattttatgggggaaatcagcacaactgcaagccctcctcgcactgcttgctgctgccatttaagctagtcacctgtttaacaatagtaataatttgatttgatctcaaggacaattgagattgaaggaaggttgtgaatttgagtgcagtgtctaaaggatgacatccatgtttgtgcctcctcccccctcaaagctcttgtctgaaacaccactgttccagaacacctggggcttctttacctgagtattatgctattctcattaagcacaagaacatgcaacaattacgtagaagtgtgcgtgtggggaaaattgaacacatttcacaagggaatggtgagggagtgggtatacaaagccggctttgaacctgcaaacccgggccagccaacatgtcacaggtgagagcgtgttagtgagagggtgatgacagttctgggaccgttaattcatggatcctcagatacactcgggcaattgttctgggtttccgggaggtgcgagggcgttcctcctccagggcgcgtgcaggccacgctgagcagccctgctgaacgtctcccggtgtgccgtctctctgtttctctgttcccctttccgtcttctctcttatgttcctacttgtcctttcttcttgacttcctcctttgttccaatgtgatgattatggacgagttagaaagaggtagtaaaa

SEQ ID NO: 73550 - DNA, 567 bp, Homo sapiens
aagatgctaagaagttctgactggttgaggcatattgggaacagatggaaaggattttgcagttacacctccctgcttaatgtaattatttccctgataatcattctctgataaatgtatggttaatttggtgctgcatttgaaacagaaggtactaaagggcccactgtgggagatgtagaggtgaatgcagcctttgcctcaatctaagcacataactaaaatttgcagcagttggtgggaaagcacggggtttgtgtgtaaacccagcattttcagggttcttttcacattgacaagctggttccaattgatgttattcatttagcaagttggcaggggtgtcaagaagagccagaagagtgggctgctacaaaggcctgtcccacgctaacacccctccttgccaaatcattgtctttactcccgggatttggcacagtctctttccacctcccacagtaagaatgctcacctgcatctgtatttcctcatctgcatacaacctagcagggcctagaaccctggctcccacttttgaaagactgctgatctttgatgttatac

SEQ ID NO: 73551 - DNA, 388 bp, Homo sapiens
gagactgttgcccagtgaaaactgcatgaattatgtaatagttttatgcttgtttcccccactcaccattccaaaactgtaagacttcaagatagaacaggaggtatgaaattttaacagcacataaaaaaatagtgaacattctatccccgcacttcattgccattactaaggctaaggcaggactgagtttagaatgcagcaaagctttgaaatgtataagagataatatctctaatattcaaatacaccataaactcaaaacttagaatcaatcctatttttaaaatactgaatgtgacaagaaacgttataaaagttttcaagatatcagtatatgatagaaagagatgtattgctttagcacaaatcattctacaaaaaaaaa

SEQ ID NO: 73552 - DNA, 524 bp, Homo sapiens
ccggatttctttttcatggcattacaacattattttaaaatagcgctactaaacagttttatcaaaaaattccaacaaatgacatgtggcccagtggatgaaaaaaaattctgcaattattaatagatgtttttactgttcagagttttagctgttatttgtttagtaatgttggtgtttgtatgtaggctttgaggcaaggggactaattaggaattctctgtaataatttaagtgaagcttaaattattaaaaagagcaatcttgtaatcccagcactttgggaggccgaggcgggcggatcactaggtcaggagatcgagaccatcctggctaacatggtgaaaccccgtctttactaaaaatacaaaagattagcctgttgtggtggtgggcacctgtagtcccagctacttgggaggctgaggcaggagaatggtgtgaacctgggaggcgaaggttgcagtgagccgagatcgcgccactgcactccagcctgggtgacagagtgagactccatctcg

SEQ ID NO: 73553 - DNA, 397 bp, Homo sapiens
tagaatctctgggtgtagaactcaggtatttgcactttctaaacactgtttgcactttctaaacactgtttgcgaagcatggttgtgtgggcactcacaagtatggagccaagagagtagactctgaattccttcaaaaataataatactaataacaacaacaacaataataatagtgataataatgctatttcttgagtgccttctctgggttagacatttagctgtttccatgtgtgattatatttaatgttgacaactctacaagaactgtatgattttttaccttttacaaatgaggataaatctaaactcagagagataagtaacttgcctaaagtcatatagacagagagttgcaaatctgatgttcaaacctcatctgcctgttcatgtt

SEQ ID NO: 73554 - DNA, 256 bp, Homo sapiens
tttggctaagattcctacagccttttaatataactttgaatatttagtgaactataatatcttctagggcaagtagagagaaaaagtgtgattagggtctaaaagcaaataaaacttaatatcctctatgtgtgcctagaatattaatatattttcttttatttttctttttctaaaataatacatgaacataattgaaaatatgtaataaaaacaaaaaactggaaaaaactgtcatatatgtacttctagggtt

SEQ ID NO: 73555 - DNA, 502 bp, Homo sapiens
aatgaatatataattacaacaaaagaggtctaacactatagtagaaaagtttggggcactcatcccattcataattattttacatttaaattactgttcctacttaagtggtgagcttggtaaccattttcatatcaggtgatactgctgcagtaatcatagctgtttgaatcaggaataatcccaatcacattttctcttaatcgtttattatactgggcattggggttgcaagataatgcacagtccgagctcaatacatgtcttcatgtacctgtatgtaaatcccacttttattctaaaattctttgaatattttgtttcttggaacccaatgatcctaagaaaattatgtacttttacctgaaaattaaaaccaatatttataaaaagtgtatatgcagtatgataccacttttaaaaaaagataaatttatagaaaaaagtttatatgactgacaacaatgtctctgagtggtaggattacagttaatttttattt

SEQ ID NO: 73556 - DNA, 878 bp, Homo sapiens
gttaaatttgaattaattattattttgcataatattcattacaatgtatcatacattcttttttgaagaacagtcctatattagaatgttacttgtctcctcctcccaaagttatttgtaccccaagatatggtttttattgttggccttaaaaaaaaagtttgcttttttcctgtatatttttcttcatttagtacatatatattattgttttattctcctgtgcattttaggttttaccattacccaatgtgcctttaaatatagttttattatttaattgaaggtacacattccatccgtggaagaaattgcagccagctttaagattttaaatgtttttgtgtaaaaaacctttttattttgtaattaatatttattttaaaaacttgaaaatacagacaagtaaataaatataagacaaaaatcattcataatcttattcaggttcatccaggtttttttctgtgtatttttgcttatagtatatgcttacaaaaaagttgaatcgttttcgcttatattttttctttgcttttggaacttacacagcatcttttgcgagtcaataaattgtgtttctgctgtatttttaatagatacttagtctgtaatacaaaacatgagattcaacaaactgtaaatttaattaagcaaccctttgtggttgaagggcctagtttggtgtctggcatttagtatacactgctagcatctgtgtaaaagtgtgtgaacattttggaagcttcaataaatacattgtgtgaaattgtcctctggaagttacactgtattagctatatgtgagattgctcataaccctatattatgttaggtacactgtgttacccttaaaaaactttgctattctttctagt

SEQ ID NO: 73557 - DNA, 382 bp, Homo sapiens
ccacgcccagctaatttttgtatttttagtagagacggcgtttcaccatgctggtcaggctggtctcgaactcctgacctcgtaattcacccacctcggcctcccaaagtgctgggattacaggcatgagccaccgcgcccagcctgcttgattcttataccctgtcatccagcacacttccttccccaaactgaatgcaagccccccatgggcagagaatctatggtgcccattttcagtcacccgtgctgtgcctagcatagcttcctgcacccatcagcgctaaaatatcccacggatgctgtcttgatggcagaaggcacttttcaatcactgtgcaaatggcgccttctacccccatgatggcatgtgcacggcatg

SEQ ID NO: 73558 - DNA, 853 bp, Homo sapiens
agcagcggcggttttttttcccatggcgctctggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtgtttcctgtaatgtttctgtggataaggaacagaagctatccaaacgtgaaaaggaaaatggttgcgtccttgagactttgtgctgcgcggggtgctcactcaatcttggctacgtgtacagatgcacgcccaagaatcttgattacaagagagacttgttttgcctcagtgttgaagccattgaaagttatgttttagggtcctctgaaaagcaaattgtgtcagaagataaagagctttttaatcttgaaagcagagttgaaatagaaaagtctctaacacagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaa

SEQ ID NO: 73559 - DNA, 974 bp, Homo sapiens
agcagcggcggttttttttcccatggcgctctggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtgtttcctgtaatgtttctgtggataaggaacagaagctatccaaacgtgaaaaggaaaatggttgcgtccttgagactttgtgctgcgcggggtgctcactcaatcttggctacgtgtacagatgcacgcccaagaatcttgattacaagagagacttgttttgcctcagtgttgaagccattgaaagttatgttttagggtcctctgaaaagcaaattgtgtcagaagataaagagctttttaatcttgaaagcagagttgaaatagaaaagtctctaacacagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaaaaatcgggctttttttggggggggaaaggttttgaagggcggggcatagtgttcggaccggtttgtcaaggggaatcgggcccaaggggggttattgggtctgcgggagaaaagaaagggt

SEQ ID NO: 73560 - DNA, 756 bp, Homo sapiens
agcagcggcggttttttttcccatggcgctctggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtgtttcctgtaatgtttctgtggataaggaacagaagctatccaaacgtgaaaaggaaaatggttgcgtccttgagactttgtgctgcgcggggtgctcactcaatcttggctacgtgtacagatgcacgcccaagaatcttgattacaagagagacttgttttgcctcagtgttgaagccattgaaagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaa

SEQ ID NO: 73561 - DNA, 412 bp, Homo sapiens
tgatgattgtataaaagagatgtagattataggttgagaactactgttgatagaattatgctttatttttaaaaaatttatgcctctaaatagttttgttaaacactgaatatctaccttgtaatgtatgacatatccaaaattgcattaagtgtatatcttaattatatttaaccatgtataatttttaattatatgtgtgtttctttatttttttattttttaaattcaatagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaa

SEQ ID NO: 73562 - DNA, 341 bp, Homo sapiens
taatgagttgctgcttcgtttcctaaagcaagacatttctttattgcagcgtccttgagactttgtgctgcgcggggtgctcactcaatcttggctacgtgtacagatgcacgcccaagaatcttgattacaagagagacttgttttgcctcagtgttgaagccattgaaagttatgttttagggtcctctgaaaagcaaattgtgtcagaagataaagagctttttaatcttgaaagcagagttgaaatagaaaagtctctaacacaggtaattttattctgtacattttatatctttgtatgaacagtttgtcagtgaagaagtgctcccccacaaacg

SEQ ID NO: 73563 - DNA, 1585 bp, Homo sapiens
agcagcggcggttttttttcccatggcgctctggggcgcgggcgatttgtaggtaatggcaggcgttcggtcactgaggtgtagcagaggatgcgctggcggctgtgagtgcggcgacaagggcaaatgcagcgactcctcgctgttgggcaagagactctccgaagactcgagccgccaccagctgttgcagaagtgggcgagcatgtggagctccatgagcgaagacgcgtcggtggccgacatggagagggcgcagctggaggaggaggcggcggctgcggaggagaggccgctggtgttcctgtgctccggctgccggcggccgctgggcgactcgctgagctgggtggccagccaggaggacaccaactgcatcctgcttcgctgtgtttcctgtaatgtttctgtggataaggaacagaagctatccaaacgtgaaaaggaaaatggttgcgtccttgagactttgtgctgcgcggggtgctcactcaatcttggctacgtgtacagatgcacgcccaagaatcttgattacaagagagacttgttttgcctcagtgttgaagccattgaaagttatgttttagggtcctctgaaaagcaaattgtgtcagaagataaagagctttttaatcttgaaagcagagttgaaatagaaaagtctctaacacagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaagaaaaaaaaaattagccaggcatgcgaaacgctgaggtgggaggatcagatgagcttgggaggttgaggctgcagtgagccttggtcatgccactactgtgttctagtctgggcaacagagtgagaccttctctcaaaaaaaaaacccaaaattgtagaattacttctatagctatattttatgataaagaagtgattgtttctcaaaatcgcattttaaagacgttttatggtacttgttggaattgggacttaggagttttgattttgataagaaactgggataattttctgaactttttttcctctgtatcacatttatttactatttttaaaaactttgacatttaacacttgggacaacatttattataaatgataagaaaaatcttagaggtttgtctacccacagtgtcatggaatcttctctgaaaactaatccataaagttccctggagaaattggtcagaatgatctgtcagaaccatttgaaaacttgctcaagagcagttgcttatatatagtaggattttactttttcctgcttatgtactactatatgcttaaaaaacctggaggaatacttaccaaagaggagtaaccatctctgagggtgggattctgggggaatttttgtttttttctgttttctataatgtgaaacttttgtagtatgtatttttctaattgaagagaataaagattaaaacaaagtgctttaaaattgatttt

SEQ ID NO: 73564 - DNA, 1144 bp, Homo sapiens
tgatgattgtataaaagagatgtagattataggttgagaactactgttgatagaattatgctttatttttaaaaaatttatgcctctaaatagttttgttaaacactgaatatctaccttgtaatgtatgacatatccaaaattgcattaagtgtatatcttaattatatttaaccatgtataatttttaattatatgtgtgtttctttatttttttattttttaaattcaatagatggaagatgtcttgaaagcattacaaatgaagctgtgggaggccgaatccaaattgtcctttgccacttgtaaaagctgaactctagtctgtgtcctccattctgcccccgcccttcctccccttatttgttaaatgaagcaacatagtgagacgtcgtctctacaaaaaaaaaaagaaaaaaaaaattagccaggcatgcgaaacgctgaggtgggaggatcagatgagcttgggaggttgaggctgcagtgagccttggtcatgccactactgtgttctagtctgggcaacagagtgagaccttctctcaaaaaaaaaacccaaaattgtagaattacttctatagctatattttatgataaagaagtgattgtttctcaaaatcgcattttaaagacgttttatggtacttgttggaattgggacttaggagttttgattttgataagaaactgggataattttctgaactttttttcctctgtatcacatttatttactatttttaaaaactttgacatttaacacttgggacaacatttattataaatgataagaaaaatcttagaggtttgtctacccacagtgtcatggaatcttctctgaaaactaatccataaagttccctggagaaattggtcagaatgatctgtcagaaccatttgaaaacttgctcaagagcagttgcttatatatagtaggattttactttttcctgcttatgtactactatatgcttaaaaaacctggaggaatacttaccaaagaggagtaaccatctctgagggtgggattctgggggaatttttgtttttttctgttttctataatgtgaaacttttgtagtatgtatttttctaattgaagagaataaagattaaaacaaagtgctttaaaattgatttt

SEQ ID NO: 73565 - DNA, 758 bp, Homo sapiens
agaacctctcaacaaattacatcagcttatagacatctttttcttgtagcaaaacatactgttttgttggcaaaaggagaaaccaaaatttgactgtgtttttatggcttgtggaacactctcagatgctaaggacgttttgaggttgtgatacttgtctgacatgtagtatccaggagattcttctctaattattttaaggattgggggaaaatgaactagctgactttatatttggaaaactaaaactcaaaacctttttcattgttgattattcagaaggaataatagaacagaattatagctgaacagtgttcaatcagagttagaagaagtgaatacaaaataataatcagaactctacagaatataactgcaatggaacaaaaggtggcaagtacttgttattcttcaaacatgggatccattacttagtgcctctacatacctgatgataagttaagcaaagcagattcagaatttaaatattatgtattcccaaaagaggtagatgaatcttaaatatatatgagaatttaggtcaaaatattaaatagcaaccaaattatgaaatgtaattttatcctatctttgcaaatggttagttcttgcttgggaattagccatttaataagcttaccataattccaaaatttaaaaggtgatacctgtggtgatacctaggtgatttaatcagaattaattttgtataatgcctgttgtaatacacctaattttagttaataaataccgtgttt

SEQ ID NO: 73566 - DNA, 439 bp, Homo sapiens
tgtgttgcaatttaaaatttttaacaaaagttcatgatactcagagaattgaaacaggtgagatcattagacattcgcatgtttgagcacaagcgctgaaggacttagcaatgtggctgcagtggaataggagagatgcaaaataacagacaaacccagagaggtaagagagcagacctcttcatgagaggctgcctgataaactgatttgacactgaattgctgagaaggtaatgcaaatagtttttttctccaagaacaaagtagttcttggtcaagccgatttgatttgggctgtgggaatctgcacaaaccatttcactagctaagtctcaggttcctcaaatgaaaaagcagggactggaaatggcttttgaagtctcattctcttctaaaaatgtcaggctccaagacaaccaggtgaagtccaagagttagt

SEQ ID NO: 73567 - DNA, 1591 bp, Homo sapiens
  misc_feature (1496)..(1496): n is a, c, g, or t
ctagcttaacttcatttaaagaataaattaatcgtttttaaacttatgccagcagttgttaattcccagatggcaggtgaactctctaaacatttttttaaaacttttcatcaaatagtaattccattttaacccaaaaatagctttttgttttctttcttaaaacatgaccatgatgcatcgtcaatcaaaataaactgaagtatttattaattacagctgtattgatttctactctaaactgacttcctccgaaatctagtatgtttcatgtttcaagaattaatttcttgatggtactctgctgcactgtaatttagtcatggtggattgagtcaccagatattaagacagtcatgattgcaaatgacagatggcatccagtggctcaccattgtttgtacctcttggtacccatttctctgaagctacaagtacagccatgaggcagtggtaactgtcttagttggagtctcagagctcatgcttcatttattcccaaggcaaggcactaaaaagccatagttggagctggagcacttgccaacttgtatttctgccatttagaaggtgctcagtccctacatctaaaatttgaagggaaaggaaatcttccatatgaatgccacttttcgttattttccagaccatcacatcttacttttcctttcattcaacaatgataacttattcgccaacacttttcaagaatgtgtttacatgaaagcagagcaagcatgttaagagacccagactgcaaataactttggaacggcttcagtgtaattcaaagtgagtcatcctgcctcagttacagaatgagcagctctgattgacagaacttggaaaagctaacacagagcggcaaagggtattccccaaaccttaatttatttctgtttgagagcaaaaatattgggaaattatccatctacagcttaccttttcttactgtgtaatttgattttaatgctggaggatttaccgtttacataatttgatcttcaatgaaattactccttatgtccgacttttggttcagattatatctaaattaagagattaataattatttttaaaggtagtgaactagcgtagatcagatggtatgattcctgactacgaaaaggaatttatttgggcaaggattactggtatgtctattgcttttgttgcgtaaatgaattgatttccacctacgccataacagtgtatctcacatgcaacgactaagctggagttgcaggagctttcttgtctgccactgccctcagcctccattctcccttcctggtgccccagtacagcctctgttctcctttttcatagtttccagtgggagcatctccacttcccttctttttgaggggcctggtcatcttcacttccacacagcccacaaacttctcacttgtatctctcctggtacagtagccatgccataaaacaagatggatactgatcagttactcaggctagaaacttcaaagccatgnaacaggttcaagaagagagtactacaattagacttacgctttagaaaagtcagtcttttacctgagcagtattatatagtacaatgcttgttatg

SEQ ID NO: 73568 - DNA, 336 bp, Homo sapiens
gcagaatcctccgggaaatgtagtccagagcccgactgctcccctactaaaaatacaaaaattagccgggcctggtgggcgcctgtaatctcagcttcttggaaggctggggcagcagaatcgcttgaacctgggaggtggaggttgcagtgagccgggatcgcgccgttgcactccagcctgggtgacagagcgagactccgtctcaaaaaaaaaaaaaaaggtaagcagacatgtctgctgcccacatgaggtttacattctagtctggagaaaaaaaaagattttaaattaaaagtggaaaatgaagtaattttatattgtgataaatactat

SEQ ID NO: 73569 - DNA, 819 bp, Homo sapiens
ttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaaatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggacatacagtccacactgaaggtcaccagctgtgctgactgcaggactcacttcctctcctgcaatgaccccactttctgcccagccaggaaccggcggacctccctgtgggctgtgagtctcagcagtgctctactcctggccatagctggaggatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaaaaaaacaagaaccacatcgcaaccaacacacagaagggc

SEQ ID NO: 73570 - DNA, 698 bp, Homo sapiens
ttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggccaggaaccggcggacctccctgtgggctgtgagtctcagcagtgctctactcctggccatagctggaggtgggtgagtgacctctccaagccccagcatccccagggaagacacacctattccctgactgactccaccctgtttcttggcccagatgtttcttttactggcaaaggaagaaggaggcagtaaaggtactgggaaaggagaccccgacccaattctagggctcccagagggaaaagctgggtgtgccctgggagtctcagggcctggaaccccagtgctgacctcctggggtctggcgtgcagaacagagtg

SEQ ID NO: 73571 - DNA, 464 bp, Homo sapiens
ttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatggtgaggaagccaagagccccagggccttggggcttgggttgacaaaggcccaccctccaaggcattctcagaggcccatgtggccatgggtgggaggtcttgtgaaggtgggagatgaatgcagtctgtctccgtgtgctctttggaa

SEQ ID NO: 73572 - DNA, 1166 bp, Homo sapiens
ttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaagggtaaggggtggggacgatccctgcacacggcctagccctccacacctgccaagacccaaggcatgcagatttcactctgcagccccctcgatcatccccaggagccccacccctctccatgaatgccttcccggctccatctcctacttgcaccccagaaccccttggctctgtctgcctccccagcacctcagtttctctaccttctcaccctccctggcagcctgcaatgagtcctgtggtgagtatgcatggggactgggcctgggggagggatgaaaggcacctggcaccccctagcccctgtccctcccctcccatagacatacagtccacactgaaggtcaccagctgtgctgactgcaggactcacttcctctcctgcaatgaccccactttctgcccagccaggaaccggcggacctccctgtgggctgtgagtctcagcagtgctctactcctggccatagctggaggatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaaaaaaacaagaaccacatcgcaaccaacacacagaagggc

SEQ ID NO: 73573 - DNA, 749 bp, Homo sapiens
ttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggccaggaaccggcggacctccctgtgggctgtgagtctcagcagtgctctactcctggccatagctggaggcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaaaaaaacaagaaccacatcgcaaccaacacacagaagggc

SEQ ID NO: 73574 - DNA, 844 bp, Homo sapiens
ttccaggcagggcactggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagatatctgatgggctgaaggagaaggcacctcagtttctctaccttctcaccctccctggcagcctgcaatgagtcctgtgccaggaaccggcggacctccctgtgggctgtgagtctcagcagtgctctactcctggccatagctggaggatgtttcttttactggcaaaggaagaaggaggcagtaaagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaaaaaaacaagaaccacatcgcaaccaacacacagaagggc

SEQ ID NO: 73575 - DNA, 414 bp, Homo sapiens
ggaccattagcatggctgccttgccctctgctctgggttgggtttggccaggggagactcccaggaggaagttagagagacagggaggaggccagagtagtgggaggtcagggtagaaatgcccagcttcttctccctcagcaggaacagggcagcccgcatgtcttccagaagtgaacagaggccgcagctaccaccgtcacaaagttcactcatctctgggtcccggtgaccccatccccccataccctccatcctgggtcctggggccccaaagctctgaggcctaggagactgcgctgtctcgtggtttgcctactcctacacctttgtaaagagtctcttcattaaaacccctcttcatagcctaaaaaaaaaaacaagaaccacatcgcaaccaacacacagaagggc

SEQ ID NO: 73576 - DNA, 3708 bp, Homo sapiens
cggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73577 - DNA, 3966 bp, Homo sapiens
gtctggggacttctccagggttctacaaattgtttcaatccttgctgccactatccgtaattaatggtatagtttcagctatcctgcaactatcctgcatctttgtcttatttaaaagaagaaaaaaaaacccagcagaatttaccatgttattttatggcaggtaatgatgaactttgctgatgtgtagttacagtgtttcaagcacttgtattttgctttttctttcttgtttttttccccattaatctttgggtaaaaatctcttgtttcgcatgtaactatcattagagctgggtttgcctttcttctcattttgtccttataaggccatcctgttttatcacttcctgcttcagctcctgagtttttctctcttcccctctccctctccctctgccgggtggatgctttctccatgtggcaaggctgtaactgttcacagctgtctgaaacagcagtggaccaggagcagcttggagttttaactttcattttacaaagaacaacatgtttgaatgtttcagcaggcaagttataactggcatctacttcttgttcttctagaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73578 - DNA, 3349 bp, Homo sapiens
tccttattccttatgacaataaaatgcatgttcttttatgttgaggctctgttttgagaagtaaaataaattatgtctttagtacaatatatgaattgtatatggaaaaacatgctttttgaaagtcccaccaaaaaggtttctttatggtatcattaaatataatttcagtttttatatgtatacatcatccctgtctctctttccaggccgggcatttatatatgtatggtcagtatattttctattattggcacttggcatctcctttcccctgctccagaatggtcttttctgataaaactcacaagctttgcattaccacaagctctgctgctagaagagtgaatcacaagaatgttgtatgcttggggtgttctgtgtgcctgtgttgatgtgtctgtattctaatgagcaatccagttttacactagcatacagatatttaactctgaggtatgtgtccacaaagctgcttttgtcatttcactagtcagtgggttttgcttgtgagagttagggggttgatttgacccgaggcttcttagaagaattttttaacattccaagtttatctaatagatgtgctatgaagagaacagaatgatgggactttaaaaaaatttttacagttatttttattttgtagaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73579 - DNA, 486 bp, Homo sapiens
tctcataaagcagggactcctccctcattcatcttgcaagcaaatcccatttcttgaaaagcctatggagatctcggtatggtagacttggacatctctctggcttctgaagagcctgaagctggcctggaccattcctgtcccttagttaccatactgtcactggagtgatggtgtccttccctgccccaccacgcacgctcagtgcctttgggtttcaccttccctcgacttgaccctttcctcccccagcgtcagtttcactccctctgggtttttatcaaatttgccatgacatttcaatctgtcaatcataattatgattgacagattgtatggatgggagggagaggtgtcttaagctgtaggcttttctttgtactgcatttatagagatttagctttaatattttttagagatgtaaaacattctgctttcttagtcttacctagtctgtcactcatactggggatctctagagtcgc

SEQ ID NO: 73580 - DNA, 878 bp, Homo sapiens
aatgtacaggctcgttgaacctcactcttcacctggcagtcacctgcttgagttacaaaaggaagacatattacagtatctcatggaatgtctatggaaagtgttcttccgaaaagcaaagtatgggcactttacattaatgacagatccttccaacaccaggaaaaacactgcttatctgttgaagaatattcgaacactaacaactatggctcaggtcttctctggtcctgtcagaaatcaggttctcagtgacaagtctttcataccaaataatgatggtgtttggaacttcttggtgtattgatatgttaatttacatgttaggaccgaagcttaaataatatgagttgcaggtaaacccccctgtgacctaatttaatagaatgttttcccttggtatcacagaatcacaaagttaagaaatctcaagaggttacttgtttaagcccttacttgtcttaaccactgtataaatgataataatggcaataataatagcccctggagagcatgtctttttctctatgttgcctcactttatttctgagaaaatagttgttacatatcatttcttccaagtaactcaaagtgcaaatataaatgtgacaaatcggggaaacattccaaattaactcattttaatcatagagtcttacagaaggaagtaaccaagatgtcactttctccagctttcctttctgagcaatccttcctaaaatactcttgaaagatgttttggcatctgtgtgacatttctagctattagatagctctagctagacagcttctccaaacatgcagccaaagtgtacctcagtcacttccactcattagttcttctgctgcccactgtgttaatttttttctccaaagca

SEQ ID NO: 73581 - DNA, 900 bp, Homo sapiens
ccggagatggagtcttgctctgtcgttttataccccctttaacatttgtcactcttcagaatggttcgtaacttaagggaaaaaactttaaaaagataaaacttatcatcctgcaagagacaccaaatctcctaaagtcagcccaaaacaagccatctgtctataactggaactctagagggagtctttggcttttagagcactggtgctaaaagctactgtgctaatgatattctgttgaaggctcttgaataaagtaaaaagcatcatttagtgacaagtctttcataccaaataatgatggtgtttggaacttcttggtgtattgatatgttaatttacatgttaggaccgaagcttaaataatatgagttgcaggtaaacccccctgtgacctaatttaatagaatgttttcccttggtatcacagaatcacaaagttaagaaatctcaagaggttacttgtttaagcccttacttgtcttaaccactgtataaatgataataatggcaataataatagcccctggagagcatgtctttttctctatgttgcctcactttatttctgagaaaatagttgttacatatcatttcttccaagtaactcaaagtgcaaatataaatgtgacaaatcggggaaacattccaaattaactcattttaatcatagagtcttacagaaggaagtaaccaagatgtcactttctccagctttcctttctgagcaatccttcctaaaatactcttgaaagatgttttggcatctgtgtgacatttctagctattagatagctctagctagacagcttctccaaacatgcagccaaagtgtacctcagtcacttccactcattagttcttctgctgcccactgtgttaatttttttctccaaagca

SEQ ID NO: 73582 - DNA, 3683 bp, Homo sapiens
cggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagtgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73583 - DNA, 3030 bp, Homo sapiens
gggacagagtaaacagggagaagaaataagaagataaggttagaatgaggggactagatatgatggtggataaaggtgaatgaaggtaaaactataattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73584 - DNA, 2787 bp, Homo sapiens
ttaggctaggtacgaggctcgggtgttaatcggccgaggccagtccaggcagcctgtgtcaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73585 - DNA, 3988 bp, Homo sapiens
cggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaaaaaaaaaacaaaacaaaaaacttttgggcgcgccgccaccagaaaaaaggtctcaacacaccttgcgtagggaggccgggaccccatcgagctcagtcacagcggccaaagcggccccaacaaaccggggaacgaacaggtgtggtcccccataaaaagcccgggagcgagcgctggaacatccaatggtcggggcaaccggttcaaagaggccaggatataaccaccgcagctgacacacacgtcaccgacgcgccacacacccggcgcccggcaagga

SEQ ID NO: 73586 - DNA, 2502 bp, Homo sapiens
cgacctagaggatcccaattcaggcttcattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73587 - DNA, 2709 bp, Homo sapiens
atgtgggtcgtgacttgtctaagccattctttgtaatccagacgtagctccacctatccttggtggctgctacatttagagcagccacacagtttgggaagggaatatcaagagagcctcttggctttaaagagtcagctgatagaattgtagcaggtttagtgctccatgagaattgactgaccagctaagggagcccttagacaaagtaaattctagggtccatctcaagacagtgctaactcatcgctgcccatgctaaagttgtctttttgtttttcctagaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73588 - DNA, 2431 bp, Homo sapiens
cctggtcactgaagggcttttaaagatctttttcttacttggcatcttctgaaaatactggaattgccagattttagcctcctggtataagtgagaatgtgaagatttgctaagtttatgctttttttcttttaatgacagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73589 - DNA, 2070 bp, Homo sapiens
gtagtgtctcgaggatctcttcggatacttggagcaagagcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73590 - DNA, 1547 bp, Homo sapiens
aatcgagctcggtaccgaatctcgaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73591 - DNA, 1296 bp, Homo sapiens
gcggcccaggcaatagcaggaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73592 - DNA, 864 bp, Homo sapiens
gagctgtttaaagactaaataatctcttaacaggtaaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttgaacttttcaa

SEQ ID NO: 73593 - DNA, 2184 bp, Homo sapiens
cggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagaagtttcaggcacctgcaagagagacctgcgtggaatgtcagaagacagtctatccaatggagcgtctcttggccaaccagcaggtgtttcacatcagctgcttccgttgctcctattgcaacaacaaactcagaagtcagcccaaaacaagccatctgtctataactggaactctagagggagtctttggcttttagagcactggtgctaaaagctactgtgctaatgatattctgttgaaggctcttgaataaagtaaaaagcatcatttagtgacaagtctttcataccaaataatgatggtgtttggaacttcttggtgtattgatatgttaatttacatgttaggaccgaagcttaaataatatgagttgcaggtaaacccccctgtgacctaatttaatagaatgttttcccttggtatcacagaatcacaaagttaagaaatctcaagaggttacttgtttaagcccttacttgtcttaaccactgtataaatgataataatggcaataataatagcccctggagagcatgtctttttctctatgttgcctcactttatttctgagaaaatagttgttacatatcatttcttccaagtaactcaaagtgcaaatataaatgtgacaaatcggggaaacattccaaattaactcattttaatcatagagtcttacagaaggaagtaaccaagatgtcactttctccagctttcctttctgagcaatccttcctaaaatactcttgaaagatgttttggcatctgtgtgacatttctagctattagatagctctagctagacagcttctccaaacatgcagccaaagtgtacctcagtcacttccactcattagttcttctgctgcccactgtgttaatttttttctccaaagca

SEQ ID NO: 73594 - DNA, 1395 bp, Homo sapiens
cggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacaaatgagctgaaagccagtggtggcgaaatcaaaattcataaaatggagcaaaaggagaatgtgcccccaggtcctgaggtctgcatcacccatcaggaaggggaaaagatttctgcaaatgagaatagcctggcagtccgttccacccctgccgaagatgactcccgtaagcattctttcttagatctggaggatgaggttcttgttttctatctgtatttggttcaggggtgttcccattactgtcagtgctgagaaaataacatagtaaatcctctacttgaatttaagggctaatgcttgaatgtcctttacacacttcatggcttaaggagaagttaaattcaattgaatatagttaacttgggacaaactgaatacttgtaa

SEQ ID NO: 73595 - DNA, 1465 bp, Homo sapiens
cggggcggggccgcaggagcagtaggtgttagcagcttggtcgcgacaggtgcgctaggtagagcgccgggacctgtgacagggctggtagcagcgcagaggaaaggcggcttttagccaggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaccagaaagcagctgaagaaacaaacatggagaagaagagaagtaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaagattctccgggcccaaagccgaagtgcaagtggaaggaagatctctgaaaacagctattctctagatgacctggaaataggcccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacagtatgtgttctgcatcattcattcattcattcattccatcatccagcagatggtcactgagtactggaattaggaaatgtcaccagacccttgtatctgagccctggtcccctagctgttctcttttcacatgaaccctaccctcgctggatttgcagttcttaccatggtctaatcctgactttgctttcttagtcctggttcccaccccactcactttttttgtgatgttaccagtgagtatcattgagagtttccctggctcttctacttaatctttgtgttgttaaagaagtagtattttattagttttaatataactcttattttatcttggttgttgagggaagaaggaagaagactgaagagcttattttggcttttgagggaagaaagaagaagactggagagaaatatcagctgtgttcattaacgagggttttttttgtgatttttt

SEQ ID NO: 73596 - DNA, 1185 bp, Homo sapiens
atgtgggtcgtgacttgtctaagccattctttgtaatccagacgtagctccacctatccttggtggctgctacatttagagcagccacacagtttgggaagggaatatcaagagagcctcttggctttaaagagtcagctgatagaattgtagcaggtttagtgctccatgagaattgactgaccagctaagggagcccttagacaaagtaaattctagggtccatctcaagacagtgctaactcatcgctgcccatgctaaagttgtctttttgtttttcctagaagtttcaggcacctgcaagagagacctgcgtggaatgtcagaagacagtctatccaatggagcgtctcttggccaaccagcaggtgtttcacatcagctgcttccgttgctcctattgcaacaacaaactcagaagtcagcccaaaacaagccatctgtctataactggaactctagagggagtctttggcttttagagcactggtgctaaaagctactgtgctaatgatattctgttgaaggctcttgaataaagtaaaaagcatcatttagtgacaagtctttcataccaaataatgatggtgtttggaacttcttggtgtattgatatgttaatttacatgttaggaccgaagcttaaataatatgagttgcaggtaaacccccctgtgacctaatttaatagaatgttttcccttggtatcacagaatcacaaagttaagaaatctcaagaggttacttgtttaagcccttacttgtcttaaccactgtataaatgataataatggcaataataatagcccctggagagcatgtctttttctctatgttgcctcactttatttctgagaaaatagttgttacatatcatttcttccaagtaactcaaagtgcaaatataaatgtgacaaatcggggaaacattccaaattaactcattttaatcatagagtcttacagaaggaagtaaccaagatgtcactttctccagctttcctttctgagcaatccttcctaaaatactcttgaaagatgttttggcatctgtgtgacatttctagctattagatagctctagctagacagcttctccaaacatgcagccaaagtgtacctcagtcacttccactcattagttcttctgctgcccactgtgttaatttttttctccaaagca

SEQ ID NO: 73597 - DNA, 489 bp, Homo sapiens
gtaagcagagagttccatgtgtatgaggtcctttaggaagtactcactagtagtaacatcttttggactcgaagccaatgcttttaaaggaagagtggcacaaattaaaaggaagtctgcctattagatgcaagccattctcaaatctcattgctctcgataaatagctttttttttttttttttttttgagacggaagttgacgtgctcccaaagtgctgggattacaggcatgagccgtcatgcccggctgcttttttcatatttttaatccacccttgttagtggtaacctatggtaagcaaagggtactttgaggagctataagtaaagtgctacgatcagttttgcctccagtcatctggggtttgagggcttcagtagatgggctgtgtcccctatcaggtttggttaccctgtattaccagtgataacataacactttgagagtggaattatgttttaaaggggacatatacaggcacttca

SEQ ID NO: 73598 - DNA, 445 bp, Homo sapiens
ggtagagcgccgggacctgtgacagggctggtagcagcgcagaggaaaggcggcttttagccaggtaagggccttctctctccacaaccggagagtgcgggaagaccccggcttctctccacaccctctttctccttcgacttttggggcggggggagtgcaaggagtgtgagtccctccccctcgagataaggggtcgagggacgctgatcctccgttctttcctcacttctggggcctgcgctgggtggggagtgcttatgtcgggctgagcctttgctgcccaagggcgggagctgcaaataccccgtcctctcccaccgagaacactgcattctaactgtatactttctggtgtggtggaggaaggtgacaattcattaaaactccaaataccctccttccagggaaatactgtaatattcaactgttctttttccttcat

SEQ ID NO: 73599 - DNA, 3366 bp, Homo sapiens
actgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctccggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgtcgtaatttatgattcctggttatgtattttgtgggatcctgcaggtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttttcaaatatttttccttgttgggtctggaaaaggaattctactttgatctgcatagaaaattttgatacaattttttgaaagttcttaggtgaaacatttacccattaaaaaggaagcagaaatactgagacatgaaaggcattatcaactaactctagactctagaacccattctagcatatctcacgtgcaatttttaaaaataagttaataattcatctcatatcaacaaaagcctttgaaacatgggttttcactagatatcacctagtgctaagataaaaaccaaaacaatatcagaattacatttatgctctaaatttgtagttgtccattgttgtgcttagtaaatgtgtgtcattaatgctgtattctcctagctattatggaaacttgtttaaataaagatatggatataaa

SEQ ID NO: 73600 - DNA, 3045 bp, Homo sapiens
  misc_feature (2950)..(2950): n is a, c, g, or t
  misc_feature (2956)..(2956): n is a, c, g, or t
actgaaggcaggtggatggagtcagtcctcagttgcccctgctggccttcctggtgcttaccatcagcccaatctttgcacagtccttgttgttcttacttctctgcatgcattccttcagaagatcagtcatcaactttttcttaattcctctgtgacacacaatgggaattcaaaggaagagatcttaaaagtcacaacagttctttatcttaataatcccctccccattcaccttactacatgcagactcacctcacacccttacaacttgaagctgaaaatttaaaagtaatttccctttttgcagcttttcctcaggttaaggctttgatctgcctgagagtaactctaaaaggagggaagataaatatgggataaaatccacaaagtgtagcttctaattcctttggaagtttaaaaaatttccacatatctgatgcttcttttgtcaggtgcagaagcacaaaaacatattccgaagccaactgatagggaatttggggattattgtcagtttggagaatttgctgtgttatttcttcatttccatggatagctcatagttggctctttctgggtgagtaattatgtgtaatatagatcaaatcttttactaaggttacagctacatgttaggggaggctatgaaaatactatattattataatttcagtgcagtgattgttgtgagaaataactttcatggtaaccctaggaaaatgggcacctgccaccatcctgagaagtcctcacacaatgccctttctctcttacacacacacacacacacatacacacacacacacccccgtcactaattcatagagttccttagcaggcatagtcaaggatcctctgggtaatgtcagctgcttagtgataaaacagagccaaaactagtgcatcctgttgaaagtaatgcagaaacagtacctgggtccagatatgctttcctgcggcgctttcctctgttacctcgtttcatcctcacagcagcatggacggtaggtggggtcgcttctacaatcatttctgatgatagcttgggaatagagataggggcagtgacttgcctgatgtcgcacagccctccggctgtcctgctttcccatatggagcagtggtggtgtgggcacctgtgatgcaggagactttaaaaatgtcgtgaggtcacgtgctgcccctcctggtacgtgtggaatgcccctggccagcaaggggtgcttttttatcagagttggcagctggcatgtgggaaccgagcaagtgctgcgtaccaagttacttgttttaaggagaccaagtgctcagcgccaggtggttttcttttttgtcatagttacttgctataactcagcttgacttctgtcatgaatcagtgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactgggtgccttccgagggctgtcactgggcaggccatatacaagtcagtgtgtgcgtgggcactgcagtgtgtgcatgccgtaggtgttgatgggtgctaggaggggtgtcgtgtgcatgcgcgttgaagaggatctgtattgccgtgacctctgttcatggatgagtgcattgtaatttgttctcaggctgtgctgtgagggccgccttaacccttgctcccttcccttctagagctgccttaagttctccagaacttttcttctgtaaaggatatcttgcctggaagggatatcttgccctgtttctcaaggttttgtgagagttttgactggatgtggccctgcatgaccctccttctcctgtacttcctctttcctttccaaatgggaattagaactgtggggcagcaacagtctcagagccagtgagaggccagcttagagaatgcttctgagttagtgggactctgtgtcacaagtaagcaaatgaatatatgaaagaaattatggagataagttagattcttggtaatacttaaatgtcttgctttctactaaccttttgttactaaaggtaaagggtataactcaaactttttgtggacattcttttcaaaattttttaagaaccctgtactataaaaggttgagtaaaaacaggaaagcgtgctataagttcaaatctgttgtattaccctaaattagataaaccaacctgaattatagtagatttctcaatagatgaggaactgaaaaatactatgtaaaatatcttccaaaatgctttttatactttttttatttgtaatttggtctatctaaaatgttcgttagcttaacttaatgggcgttattggattcatatgactaacgtttcctcagtattgtaatgcttgaaatatttgaaagaaaaaatgttgttttttagttgaaactggtatatataattcagtgcttggcaggttagtatatttttatgcatttttcagagtcagcagtttcaaatcttattgttatcatgttataaaattttagcccacatttcaggctccgtaaatcatttgagccattattttttcccaacaaatggtgaattttttctttaaatgtggatatatatgtcgtaatttatgattcctggttatgtattttgtgggatcctgcaggtaaaattgacttttttgtgtctttgggagatttaaattgcgctaacagtgttgcgcaaaaatgagttcatgccatttaacatattgtattttaattattaactgtattaatttactatgaaatggacatccttttaactaaaatggaattgaacattgcagttcaaantttccntgggtcggaaagacacattgcggcgtaaaatggcaccttggggtttgggatcccttagggaaataaaagagtattaaaacattcgtgaa

SEQ ID NO: 73601 - DNA, 520 bp, Homo sapiens
ataggttgagcagtttctccccagaactcatatccctgcccacagtgatggcctcagcactagcccactggcccacattgattctggcaataaagctcactgtagtgcaccactaccatcgtcagcgaatggtttagttggacgcataactgtgctgaatatattgaaaagcaattagcttcctgagggtcagtagctgacattccatttcaaaacactgaatgttgtcagatataatcatgagaattcatcagactctacagagtttataagcaataatttgacaggaggtggtttgctttgaatctgggagtactgaaaatgttaaatgatgaatagaggtggataaaccaactatcaactggttcatttttttcataggcttgtttgtcatttttttctgctgatttttttcttcctgtagcttgttgtcatttgaagtctcacttcttatcgctattgagatgactgttttcctttgtgcataattttgtgtgaaataaagaatgtttggaatttc

SEQ ID NO: 73602 - DNA, 211 bp, Homo sapiens
attagatggcacttggtgatatgataagaactcaaaaaatatttgaggaataaaggaaagaagaggccagacgtggtggcttatgcctgtaatcccagcactttgggaggctgaggcaggcggatcacttgtggtcaggagttcgagaccagcttggctaacatggtgaaaacccatctctactaaagatacaaaaattaaccggggatga

SEQ ID NO: 73603 - DNA, 205 bp, Homo sapiens
gacaaaatacccatgaagaggtgattttttttcatttccaagatgaacaatttctcccttttcccctcatttcaataaagcaaaaattttacatgcccttcagggcacactctgaccccacctctgctacccacatccttgcccctgacaagaaatcttagaacagtttttatttcttcttttctctcaccccaatctcaacccc

SEQ ID NO: 73604 - DNA, 580 bp, Homo sapiens
tcacttagaatctttggctgaatactgatctgggcatctatgaagtgacatgaggctctgaaaaattagggtccccaccagccagagaagagaaatccccaccagcaggtagagttctcacaagagtgtcacaccttagtaatcaggctaaatcagcactaaagactaaacttgtcctaacaaagtttaacaacaaacatttgatccttggaaaggatcaaatctatcccaagtgtctcaactatgtgctagaacaaaatccaacactctacaatgtaaattcacactgtctggtttccaatccgaaattaccaggaatataaacaggcaggaaaatacaacccataatcagaagaaaaaccagtgtaaacagagccagaagtgacaaaaatgaaagaattaaggtcctagcagacacggaccaaaaacagcttttgtaaatatgctccatatgatcaagaataaatcatggcccaggcacagtggctcacgcctgcaatcccagcactgaggcgggtggatcacttgaggtcaggagtttgagaccagtctggccaacgtatgaaaccctgtctctact

SEQ ID NO: 73605 - DNA, 470 bp, Homo sapiens
  misc_feature (93)..(93): n is a, c, g, or t
agtgctgtggtgtggtcatagctcactgcagccctgaactcctgggctcaagtgattctcctgcctcagtctcccaagtagctggggattacnggcgtacaccactatactccagcctgggcaacaaagagagagtctgtctcaaaaaaaatgggtaaagtggctctgggcactgtgactcactcctgtaatcccagcactctgagaggccaagctgggaggattgtttgagcccagggggttgagtctgcagtgaactgtgtttgtgccatagcattccaggctgggcgacagagccataccctgtcttaagaaaaaaaaaaaagcctggtccataaggtttgagacacacacacacacacacacacacacacgtgcgcatatacatgcatatagttagtgggagatacaattcccccccccccacctgagatataatccttatcctctttattttttcctttatttct

SEQ ID NO: 73606 - DNA, 746 bp, Homo sapiens
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagggtttcatcatgttggccaggctggtcacttctgagctcaagtgatccgcccacctggcctcccaaagtgctgggattacaggtgtgagccaccgcgcccggccgaaaacaatacaattgtgaagcagttctacaccatgttcgtagcagcgttattcataggagccaaaaagtggaagcaacccaactgttcactgatggatgaatggataaacaaaatgtggcacacacatataataatggggacattattcagccttgaactggagggaaattctgacaggtcactgtgaggtgaaaggtcgcattttcaggtgtcagggaatctttactgcaatttgctgacattattgaacaccaccacatttagcatattttcacataacaaaaaacactacatgtatgtacttaacattttatagggtcgatcttccttattcatggtttcagtatttgctaatttacctactcactaacatttatttgtgactccaaaatcaatacttgtatgtaatttttcacatgtgaaaaattggagttgcccaatgtgcacattcgcagctaaggttgaacctggctgtgctctgtcttcttgttttagc

SEQ ID NO: 73607 - DNA, 542 bp, Homo sapiens
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacggtagatacccagtggtgagattgctgtgtcaaatggtagtacaatttttagttctttgagaaatctctatactgttttccatagatgttgtactaatttacattcacaccaacagtgtacaagcattccctttgctccacattcttgctaatacctgttgttttttgactttttaatgactgctctaagatggtgtctcattgtgg

SEQ ID NO: 73608 - DNA, 616 bp, Homo sapiens
agctgaaaggggccttcaagaagagagttctcagagcagactcagctttaggtgctgaaatgaatttctcaagatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacct

SEQ ID NO: 73609 - DNA, 879 bp, Homo sapiens
gcggccgccggagccggcgccgcggtcacctccgccgctgcctcggcggggccgggagaggattcgtctgacagcgaagcggagcaagagggaccccagaaactgatccgcaaagtgtctacctcggggcagatccggaccaagaccagtattaaagagggacagctattgaagcaaaccagttctttccaaaggtggaaaaagcgatacttcaaacttcgaggccgcaccctttactatgcaaaggactcaaagtctctgatatttgatgaagttgacctctcagatgctagtgtagctgaagcaagcacgaaaaatgctaacaacagcttcacgatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacct

SEQ ID NO: 73610 - DNA, 1229 bp, Homo sapiens
agctgaaaggggccttcaagaagagagttctcagagcagactcagctttaggtgctgaaatgaatttctcaaggccttttacagactccaaatagatggtcctgagctgatactgtcattgtcaccatgatcctggagacacagcctgtagctgtgtggaagtaaacttctaaaacctgtctcttctgagagttactgcatgaaaacaggcaaggatgggtcaagttttggaccagcagcccaagttccaccaaccactctgttatacagaggcttctaagctatgcagagtgctatgaagggtttattcttcttttgcccacctgactgatatactgatgtactttttgaagaagggcaatggaatttacctagacgtcactgtggtcttgatgtggctgaagtgttttgttgaaggctctttagtcctgtactcatttagattgactctcacttctggtccctttttgtggtgcagactaaagcctcaaactctgtaaaagacaatggcttgtctcatgaagagaagtgaccaactgttaataagctttatccaaagagggtcgtggaaaacaagaaaatgcaaaagtgaggttctcttcaatttcatatgcaattaacaaatatccagagctgactgattggtgctcctcttccatgtgacttttggctggctgtatttaaggatcatcactccattcagaaggctaatgctgtgtgctgagaacagaaaggagatggaggattggatcagctcactgaagtctgtacagaccagagaaccctacgaggtggcccagtttaatgtggaacatttctcagggatgcacaactggtacgcctgctcccacgcccgacccaccttctgtaacgtgtgcagagagagtctttctggagtcacctcccatggcctgtcctgcgaagtgtgtaaattcaaggctcacaaaagatgtgcagtgagagcaacaaataactgtaaatggactaccctggcctccatcgggaaggacattatagaagatgaagatggcgtcgcgatgcctcaccagtggcttgagggcaacctgcctgtaagtgccaagtgtgctgtctgcgacaaaacatgtggcagtgttctccgtctacaggattggaaatgcctttggtgtaagacaatggtacacactgcctgcaaagatttataccatccaatatgtccacttggtcaatgtaaagtatctatcatacct

SEQ ID NO: 73611 - DNA, 302 bp, Homo sapiens
tggcctccatcgggaaggacattatagaagatgaagatggcgtaagctgctgctctgtctctgctctcttcccactaactcctcttttatgttctgctcttgtggaagctgagaaagataagtaggaatgcttattattaggatttaatagaaggtttggttgattctgagtttttatttttaattcaatccttcatagcttctttagctcttagattttgaaggaaatctgttgtgaatagggcttagaagtggccgttgtgctgggctgttgttgtcgacctctgatgaactctgagatg

SEQ ID NO: 73612 - DNA, 355 bp, Homo sapiens
aatctgtcctcacatctcatttctaggtggcccagtttaatgtggaacatttctcagggatgcacaactggtacgcctgctcccacgcccgacccaccttctgtaacgtgtgcagagagagtctttctggagtcacctcccatggcctgtcctgcgaaggtactgtagcacctagcatgtgttttctcccaacagtaaccatactgtagacatgctgccactggttttattgtagcttaaaattgagctctccacacataggactagcttggaaaatatttttgctcaggaaaaaaaaacatagtcatttaaaggaaacatacatcaaaatacagcatttcacccccaagaaact

SEQ ID NO: 73613 - DNA, 802 bp, Homo sapiens
tgattgatgaattgtgagaggaagactttaccctgtacatagctgttcttgttattactataaacttacaaaaggacaaggtgttgaaacacttaaagtattagacttatgtccatggggtattcaggacactgttccaggaagtgtggatatcaacacaattagagatggagcatgaaaactttcaactgtacagacatggaagaagtttcaaatttcacatacttgtaaaaagttcctgtttgcttagcccagtttttatctggttgccttgtcaccagtgtttgtacagctcctgaaactgttgagaagtagagtgatctgtggttttaacagatggctaacttggtaagtttcagccatctcaattttatcatcaagctgcataggtccttcctagtttcctgtgagcaaggtctcagcctctgtggaaactgcatgcttgaattcatctccctacatagtcttagtggtctccttgcatagaagcagaatttaaaaatgaaaacatgttataaattaaatctcttgttcatggaatttcaagccacattgtttatatttgtgatagacatattttatatgcttgttacggtatactttttaattctatttttaacatttgttttttccagttttaatgatatacttgtaaaataagctgctccttctttatgcgtggctgaagttgttatgaattttatgtactgtgacataaaagaccctcagttattaaataataaagttgaattttatttgttgttattatttatttatttattttattttttgtgatggagtc

SEQ ID NO: 73614 - DNA, 841 bp, Homo sapiens
ccgagatggcgccattgcactccagcctgggcaacacagcgagactctgtctcaaaaaaaaaaaaaaaaaaaaaaaaaaaaaaaataagttattctgctctaagattctgttaaaaatgcttgataagatttgattaaatattgattcaggagatttcaagttctaaaattgacaccacaaaagcaagctgtcttctctcctcccaccaacagaagccaaaaacaaatatacagggccacgattattaccagcaatatcccagaactcaaacatgaggaggaaatagttcctaagaccgcaaaggtgaaaaaattctaagcagacaataagagaattagatatccatatccaagatgcccctttctccaatctgcctggcaccaagcatacaattttttattgtgattcagtttctagaatgggaaagtgagatcaaggtggacagctggcttccctgccaacttggattccctggcaggagacctgtccctgcctcaacccatgggaagtactgggagtgcctataggaagaaatatccctgacaacagccaaaaagaggaggcaaaactaccattcccagccctgaaattctgctttgtaacttggccaaaggagacaccacatcagagtgcctattcagcagcaccatgctgtaggaggttcgttccacaggtcacctggacatgaactcctacctagccttctcacactaccaagatatcccctttgggatgtaccccatccagaatgcgtacttgactatttactagaaccaaggcaaacctaggcttaaggttctatatagtgctgcaaaggatgtaatgactgagtggagaaaa

SEQ ID NO: 73615 - DNA, 545 bp, Homo sapiens
attagacagtgactatttggtgacataaacagatccagcaactggctgtcatgtgacagccattaacatgtgacaatggattgggccagtcaggtgcctcttttggggacaaactttctctttccaaaatgtgttgaatcatcaagagtctgagtgaaataaccgactagctgcacccagtgcacaggcacacctatgggtgctgctacctcgtttcccctggttctccctctggagaagtgctcctttcctccccaccctggggagcacttgcaactgtgtgggactgtttttcaggagtcaaggtgatggtgatagatactggtatttaatgggcaaagcagtgttgctaagtgttttgtgatgtgtgggaggagtctaccctaaatgcccaaaactcctctactgacaaacaatggagggtacatgatatcttggaagatcacatcttctttggctgttttcctgaagtcttcacctgtaaaacacatccgcttcagaacaggactataccatagctgtgatatttgctgttaagtacgtcg

SEQ ID NO: 73616 - DNA, 197 bp, Homo sapiens
  misc_feature (35)..(35): n is a, c, g, or t
ggtcgacgtttgtcagtagaggagttttgggcatntagggtagactcctcccacacatcacaaaacaatggagggtacatgatatcttggaagatcacatcttctttggctgttttcctgaagtcttcacctgtaaaacacatccgcttcagaacaggactataccatagctgtgatatttgctgttaagtacgtcg

SEQ ID NO: 73617 - DNA, 792 bp, Homo sapiens
cacaggaagaacttgtctgttacctagattcttatatttatttaaaatttttgagcataatggtcttagtaagcctggccatcatctgagttaaacagcctagtatattaggaagaaactggactagaatttggaacaaccctggtgcaaatcccagctctgctactaacaagtggtgtaccgttaagcaagtgccctaacccttctggatctcagtttcttatcccaaaatgggtttaaagtctcagccatatatcacaaaatttttgtgaggattcaatgaaatacgatattgtagatggtggcttttaaaaaaattactcatttgggcgaaatcctatcaaaaataaaactcctagccagagggtcagaactagaggtggtggagtgaacgccgcaccaggcaatggaagaagcactggcctagaccaagcttgagcgtgcaccactgtcacctggagggcttgttccaacacggatggctggactcacccccagaatttcagatttattaggtctgcactgggccctgagaatgtttatttaaaacaaattcctggatgctactggttcagttgccacactctgagacccgctggctttgagcttagaagatgtgggtttgattcctggattccacagtttactagctgtgagttagagaatttaaattacttacctgagtcttggtttcttatttgcaaactgaactgtaaactatttgttctacccattttataagacttttgtaaggataaaataaaagaatacatatgcaaattactgaaaaac

SEQ ID NO: 73618 - DNA, 758 bp, Homo sapiens
cacaggaagaacttgtctgttacctagattcttatatttatttaaaatttttgagcataatggtcttagtaagcctggccatcatctgagttaaacagcctagtatattaggaagaaactggactagaatttggaacaaccctggtgcaaatcccagctctgctactaacaagtggtgtaccgttaagcaagtgccctaacccttctggatctcagtttcttatcccaaaatgggtttaaagtctcagccatatatcacaaaatttttgtgaggattcaatgaaatacgatattgtagatggtggcttttaaaaaaattactcatttggagggtcagaactagaggtggtggagtgaacgccgcaccaggcaatggaagaagcactggcctagaccaagcttgagcgtgcaccactgtcacctggagggcttgttccaacacggatggctggactcacccccagaatttcagatttattaggtctgcactgggccctgagaatgtttatttaaaacaaattcctggatgctactggttcagttgccacactctgagacccgctggctttgagcttagaagatgtgggtttgattcctggattccacagtttactagctgtgagttagagaatttaaattacttacctgagtcttggtttcttatttgcaaactgaactgtaaactatttgttctacccattttataagacttttgtaaggataaaataaaagaatacatatgcaaattactgaaaaac

SEQ ID NO: 73619 - DNA, 483 bp, Homo sapiens
tcattgtattatatatatttgtatatttattgttatattttatcttttctatgaagggtcagaactagaggtggtggagtgaacgccgcaccaggcaatggaagaagcactggcctagaccaagcttgagcgtgcaccactgtcacctggagggcttgttccaacacggatggctggactcacccccagaatttcagatttattaggtctgcactgggccctgagaatgtttatttaaaacaaattcctggatgctactggttcagttgccacactctgagacccgctggctttgagcttagaagatgtgggtttgattcctggattccacagtttactagctgtgagttagagaatttaaattacttacctgagtcttggtttcttatttgcaaactgaactgtaaactatttgttctacccattttataagacttttgtaaggataaaataaaagaatacatatgcaaattactgaaaaac

SEQ ID NO: 73620 - DNA, 511 bp, Homo sapiens
ttttcctgagtaacactcttactccagatacatatacaggtcactcaactccttcaatttgtaaatctctggttaaatagaaaggtagcagatcagccctccttgatctctgccaacttaatatttgaacagagatttaaaggaaaaaatattacagaagtgggaatcctcaaaatactttctaaaactagctttggctgggattataggcataagctactgcacccatctcagaatttgtctatgtttacaatattatcaatgggtagacagctaattgcacagaatataaatgaggagaggtagatttttattaatgtgtacattttccttaattcctgatttactcaggcccaggcttctttgtttctggtcttggatctatgggcctgtgtaaatctttgtcacttagctaaaaggatttcttgaaaatccttgtagttgtttattgagcatttactgtgtactaggcactattgtaggtactagggatacagcagtgaaaaagaaa

SEQ ID NO: 73621 - DNA, 442 bp, Homo sapiens
aatattttgatgaacagaatttcttctttttatttttaaaaatatagagacaaggttttgctatgttgcccaggttgttcttgaacgcctggtctcaagtgatcctcccaccttggcctcccaaagtgctgggattataggcataagctactgcacccatctcagaatttgtctatgtttacaatattatcaatgggtagacagctaattgcacagaatataaatgaggagaggtagatttttattaatgtgtacattttccttaattcctgatttactcaggcccaggcttctttgtttctggtcttggatctatgggcctgtgtaaatctttgtcacttagctaaaaggatttcttgaaaatccttgtagttgtttattgagcatttactgtgtactaggcactattgtaggtactagggatacagcagtgaaaaagaaa

SEQ ID NO: 73622 - DNA, 423 bp, Homo sapiens
atcgcctgaggcagaagttttccagcctgggcgacagagcaagactccgtctcaaaaacaaccctaaaaccaaaaaacaaatctgtagcttgtccattgattcacaccgctgggattataggcataagctactgcacccatctcagaatttgtctatgtttacaatattatcaatgggtagacagctaattgcacagaatataaatgaggagaggtagatttttattaatgtgtacattttccttaattcctgatttactcaggcccaggcttctttgtttctggtcttggatctatgggcctgtgtaaatctttgtcacttagctaaaaggatttcttgaaaatccttgtagttgtttattgagcatttactgtgtactaggcactattgtaggtactagggatacagcagtgaaaaagaaa

SEQ ID NO: 73623 - DNA, 394 bp, Homo sapiens
ctcatctcagcgcaccaactcctgatttttttcagtgggaaatgtggtggtcatagggtagataccgatgtctgccctgctctttcatctctgaaagcctgtttgcagaatgaggccctggctctaccctcatctcaggctcttctaaagagcttttgtattctaaagaggatttttccatcagagaggtaggagctgtaggaaccccgagggcagataagcagccctcactctagataaggtatgctgggggagcttactgagggaatcctgtacacagcccacatcaaaggaaggctgagaatggcctgtggctcctgcttcccttccttgtgtttctccaacctggaagaaaaggggaagctagaaattcacatttattgagcacctgtgt

SEQ ID NO: 73624 - DNA, 739 bp, Homo sapiens
tgggtggatcacgagtcaggagttcaagaccagcctgaccaacatggtgaaatcctgtctctactaaaaataccaaaataataataataataataatgtatttggatgatatatttgtatgtgaagatgtattcaacaatatctctgcccttgaagagcttgtatttactaacagagaacaaagatgtgtttaaggtataacatggaggtttaagaaattcttacgtatagtttgagctaagcaaattctcagtcgttttgctttcagttttcatattaaatacacacatactttatttcctctactgtttgtatatctccatcttttattgacctgacataaattgctaaccatagcttcatttaaaaatcaaacaaaatttcctgtgtactttagataatattatttcatttgtctgttatcattacaatatattagtaaaagttgcctgtatatcagtattatggaaaaactcaatctttaaatatcagaaaatgaaagatgtattttgtttcctttagtgtagggtatgtaatacccattagcaagcaggcaattcatttgtttaattcaaagattatatttaactctgttgtgacatcagaagccttctttgtcattgtgaatagtcagtggattattttggcctgaatgctgtcatatatgtaacatgttagtaaatcttcctttttacttttctcttttgtatgatgatgatgggtcaacaaaatgagaata

SEQ ID NO: 73625 - DNA, 1241 bp, Homo sapiens
agaattgcttgaacccatgagtcagtggttgtagtgagccaagaccacattactgcactccagcctcggtgacggagccagactctgtttcataaaaaacaaaaacaactcatgtaccccataaatacatacacctactatgtatctacaaagattaaaaattaaaattaaaaattttaaaaaagaaatcttatcccaccatgcaaagcaaagaaccactctattctacaattaccaagcccagtatgagactttaagcaacatctcataaaacccactgaccgtgggtcaaagaccagacctctagtagttgcaagagatagatagagcttgtccagttcagctataaatcaattttatttccacagagggtcacacagccctttcaaaaacaaccatattggatcaaacacaaaattcgtaaaaaatattcctcctgttcccccaacctcaaaatatatgttgaaggtcatatggccaggggcaatgcagattcaaagccactattgtgagctgcattgactataccaccatgtaattcataatgtgttgaaaatcaaatgctcatgataaatgatcattgattagggcccctagttgtgagtgtacctatattttttcattctataaaagcaaatattaaatcaacatgaagagtaaataattacccatattatattgagagggtgaaattggtttatattccatatggagttcaattgatcattattttcatccttgacacttgggtttatccattctccaaaccaccactttggaagagcaagttaatatacaattactgctaaaaaaggtacatacctccaattttgtgttgtgttgacaattccacttgtttgttctgtccttctgattgggagtattattttcctaggtctgttttaacaaagttccataaattgagacactgaatgagtctcaataaatgtgcattctcacatttctagagaccagaagtctgaaatcaaggtgcggtccgagccacactccctctgaaggctcagcctggccaacatggtgaaaccccatctctactaaacatacaaaatttatctgggcatggtggtgcgcacctgtagtccaagctacttgggagactgagacaggagaatcacttgaacccaggaggcagaggttgcagggaacagatatcgtgccactgcactccagcctggatgactgagcaagactccatctcaaaaacaaaaacaaaaacaaat

SEQ ID NO: 73626 - DNA, 400 bp, Homo sapiens
ctgcatatttagacaatgactactcaaaggcaaagactttaccttatttatacatatattttcagtgcatgaaaaataagtaagcaggaaataaatgtttggttagttaaattaagacagttaaggtaattctttaaaaataaaaataaaaaacaaaaagagaaagaaaaaaaaagaagaaaggaagaaagaaaaagagttaaggtattctttagactcatcacattgactacataatcctgcctgacaagagctctataagagaagcagatgatatataatttattgaaccaggcctaagacatttttggagaataataactttccgtactaaaaacactgcttcaatactttacaattattgtcacatttaaccataacaaccaatatgaaacagctt

SEQ ID NO: 73627 - DNA, 380 bp, Homo sapiens
tgcctgagccctctcactgtttttgtgcctgcctttgttgtagaattctagatggcagcatgcttgcaacttgggaaggatgaggcccttgtctggagacattatccctatgagctctgaggtcttgtctccttctgtagcatccccaccaatgtggccaaagccaagggccctcatctgatcagtcctcctgattctggtccagccactgagccctaggtctactcaatttcatggcaggatacccagaaggagggaaatggcctcagccattctcattcctatttagagaagtgcattcttcaccatcatccttcctaccttttcttcttacccactgcccaaggacttcagcaatgaaaaagtagcttcccttctca

SEQ ID NO: 73628 - DNA, 414 bp, Homo sapiens
tttttttggaattagatggatgagtcacactagccatactctggagcctggcaatgtgaggttttgaaaaagcattcttcagtttagctgataccaaaaatgtttgtgttttgtgcggttactgggaatttgcctgcagccactaatcagctgaatctttaatcaccattttgctctttattgttagaatgtggaggtaaaatatcaagtgtatgatacccctatcctctgacttgaatatcaccattatccgtttccaaatagcatttctaaaagtaagttttctgtttgtaaatataatacataatcatcatagaaaatgccaatacagaaaccaaaaaatcaacactttaaatcctactaaagatagccacttaatttagtaaacattccagatacatttctacacgcacc

SEQ ID NO: 73629 - DNA, 1568 bp, Homo sapiens
acccacgcgtccgtcgacccacgcgtcgcccacgcgtccgcggacgcgtcgggtgagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73630 - DNA, 1735 bp, Homo sapiens
  misc_feature (913)..(913): n is a, c, g, or t
atccttaattaaattaatcccccccccccagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactactgcgaaccattggggtgacacagattcatcccccgtccgcaagtgcgtcggtgctcacccggcgcgcaacaggcaccagcgcccatgctcgctatacctctcgtgcctcgcaagcagggcggaaaacactgtttgggagaaaactgccctgcggccaagtgctacnatcgcctgatacctcccttccgggcattgaatagaaccgacaacagaacaccatgaacagcacaaccacggctacagcatcaccagtcatgacgatgccaaacacaccaccagagagaggggggtggagaggaaggagcagaggagcgcgagcaggacaggacgcgcgggagggcaagcgcggagagaggcgggcggaagcggcaggcaagcgccgccgccgggccagggcgcgcgcggacgtcacggccaggagcgggggaggagaaacgagagcgcaggacgcgagccgcgcgcaccgcacaggcacagacgcgcgcggcggcgcggcggccgcaccaccggcggcacagccaccaaagctgcaagcccgccgagcacgcgcggagaccagcccaccacccagcgccaccgcccaagcccagcaggaacagacgagagcggaagacgagcagcaggagaaggagcgcgacagcgcgacgggcaggaggaagacgcagacgggggcagcacagacgcgcacgccgagacggacacgagagaagagaaggagaacacagatcacacgagcacccagccccacgcgcccaaccagcaagacgacgcagcgcgagagacgcgcacacgagacacacgggcaggcaacgacagcagacgcgaacgcgcacgaaggcaagaacggaggcagcacgtacacgaacaagacagcagagcgggggcggcccaagcgcggcggccgaacacaacgcgaggcggcggcgcggaagagacgaggccaccacgacgcgagagagcacgaagcggacggcagagcagaccacgc

SEQ ID NO: 73631 - DNA, 780 bp, Homo sapiens
  misc_feature (28)..(28): n is a, c, g, or t
aaattacggtcctaggtacgaggctggngttcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgccccggaaagaatgaccaccgtaatattagagacagcatgtaaataaaagacacgtatcagtacgagtaaagagaatgaaaagaaaagataaaaagggaaagaaaagataatagaatgagaaatgaaagaaagaggaaatagcaaagtaatagaaagaaaaggataagagaaaaagaaaaatagttactagaaggggaagaggaaagaggagaaagaggggacggagtaaagatagggaaagtggaacagcgagagggagagaattagaggaaggagagacggacgaaaggaagtaggcgagtagaaagagaggagaataaacccacaggcgaacggcaagctataaagaagaggataggagttagttagattaatcgaagagcaaaaaaaaagaaaataggaaagaaagacagaaagacaaagaagataggagaacgtagcaagaaaaaattgtaagaagagaaagtgaaagaggggagagaggaaagaaaaaaagagtaaaaaaaaataaagaggaagaaaaagaaaaaagaataaagaaagaaagaaaactagataagaaaggagaagaagacagaagcaaggtagagaag

SEQ ID NO: 73632 - DNA, 1535 bp, Homo sapiens
  misc_feature (126)..(126): n is a, c, g, or t
  misc_feature (133)..(133): n is a, c, g, or t
  misc_feature (162)..(162): n is a, c, g, or t
cgcgtgtgcgacggggtcccctccccgccgaccggcctcgtgcgctcgggcccgcacgccgttgttcgcgtcacccccacccagctcccttccgcgtgtgctcggagggcgcggcgcaccgcctangcaggcnggagcggcttccccttccctcacgtgctntccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73633 - DNA, 1754 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73634 - DNA, 1555 bp, Homo sapiens
ataacgggcatatagtcagaccacggcgctcgcccacgcgtcggcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73635 - DNA, 1396 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccgggtaagcaagcttggatggccat

SEQ ID NO: 73636 - DNA, 1129 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggtatggtccacgtaaacatgt

SEQ ID NO: 73637 - DNA, 748 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatgtgtcaagatgaagttggagaggtaagcctcataatccatgataagagagcaagggtggatgctgatatggcactgaagactactgcaggagtccaagcaagcacctgactaggatggtgataggagggatggctatgagatgttcagatgtcaaatctataggattgaggtgggtcagaacataag

SEQ ID NO: 73638 - DNA, 1558 bp, Homo sapiens
taatacatcattcggctaggtcgatgctgcgtgtttaatcggccgagggagagacagagagatcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73639 - DNA, 1734 bp, Homo sapiens
  misc_feature (502)..(502): n is a, c, g, or t
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgccgggtctgctagcgtgaccacgtgcactacgggctggtgtgaacgcagtggagcgtgtggccccgtgcggccttactttggcggggcctgccgttcggggacnagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73640 - DNA, 992 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgccccggaaagaatgaccaccgtaatattagagacagcatgtaaataaaagacacgtatcagtacgagtaaagagaatgaaaagaaaagataaaaagggaaagaaaagataatagaatgagaaatgaaagaaagaggaaatagcaaagtaatagaaagaaaaggataagagaaaaagaaaaatagttactagaaggggaagaggaaagaggagaaagaggggacggagtaaagatagggaaagtggaacagcgagagggagagaattagaggaaggagagacggacgaaaggaagtaggcgagtagaaagagaggagaataaacccacaggcgaacggcaagctataaagaagaggataggagttagttagattaatcgaagagcaaaaaaaaagaaaataggaaagaaagacagaaagacaaagaagataggagaacgtagcaagaaaaaattgtaagaagagaaagtgaaagaggggagagaggaaagaaaaaaagagtaaaaaaaaataaagaggaagaaaaagaaaaaagaataaagaaagaaagaaaactagataagaaaggagaagaagacagaagcaaggtagagaag

SEQ ID NO: 73641 - DNA, 1636 bp, Homo sapiens
  misc_feature (126)..(126): n is a, c, g, or t
  misc_feature (133)..(133): n is a, c, g, or t
  misc_feature (162)..(162): n is a, c, g, or t
cgcgtgtgcgacggggtcccctccccgccgaccggcctcgtgcgctcgggcccgcacgccgttgttcgcgtcacccccacccagctcccttccgcgtgtgctcggagggcgcggcgcaccgcctangcaggcnggagcggcttccccttccctcacgtgctntccgtccgcggcctgcgcacacacccatcctggggcccgcgccccgggcctgccctggagcgccccgcgcttcagactcacccacgtgtgcggcggcggcggcgactgcgtggccccgcacccgggcggtggagagaaagggctgtcaggtggccgcggcggccggcgtgcgagggaccggatgcccaagccgggcggatttggaaaaggatagctggtaatcgtggcttgttttgctttgttttcttttccagcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73642 - DNA, 1439 bp, Homo sapiens
  misc_feature (207)..(207): n is a, c, g, or t
tggctcaggagtttgatagttcttgggcagtgagggtgagtagtagaatgtttagtgagcctagggtgttgtgagtgtaaattagtgcgatgagtaggggaagggagcctactagggtgtagaataggaagtatgtgcctagcgttccaggcgcattctaggctggattgccgtcactcgggctgaatgatagccaaggcggggacnagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73643 - DNA, 834 bp, Homo sapiens
gtagttcgatcggtagcgggatcggagagtgctcccgaaggccaggcccaacaagccggcctaccgcaggcgaaggtcctccacgcaattaccagcaaaattaccagaatagtgagagtggggaaaagaacgagggatcggagagtgctcccgaaggtcatcgcaacgaaggttttgggaacagtaaaatggttcaatgtaaggaacggatatggtttcatcaacaggaatgacaccaaggaagatgtatttgtacaccagggtgcggaggcagcaaatgttacaggtcctggtggtgttccagttcaaggcagtaaatatgcagcagaccgtaaccattatagacgctatccacgtcgtaggggtcctccacgcaattaccagcaaaacttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccgggtaagcaagcttggatggccat

SEQ ID NO: 73644 - DNA, 1609 bp, Homo sapiens
aaaaagaaatcaagaatgcaattttatttacaatagtcacgccggaaatacctagaaataaatttaactgaggatgtaaaagacctctacaaggagagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73645 - DNA, 1542 bp, Homo sapiens
atccttaattaaattaatcccccccccccagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73646 - DNA, 1320 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaaaaaacacaaaacacacacaagggcgccgctcgcggattaaaaatagaacaaacctcgaatccggacgggggtcttccacaccttaacggaactcgggaatagcgtcttaatttgaaacaagatcacattgcttgaggaacccgggattccctggaatccggaaagatgg

SEQ ID NO: 73647 - DNA, 1947 bp, Homo sapiens
  misc_feature (1125)..(1125): n is a, c, g, or t
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactactgcgaaccattggggtgacacagattcatcccccgtccgcaagtgcgtcggtgctcacccggcgcgcaacaggcaccagcgcccatgctcgctatacctctcgtgcctcgcaagcagggcggaaaacactgtttgggagaaaactgccctgcggccaagtgctacnatcgcctgatacctcccttccgggcattgaatagaaccgacaacagaacaccatgaacagcacaaccacggctacagcatcaccagtcatgacgatgccaaacacaccaccagagagaggggggtggagaggaaggagcagaggagcgcgagcaggacaggacgcgcgggagggcaagcgcggagagaggcgggcggaagcggcaggcaagcgccgccgccgggccagggcgcgcgcggacgtcacggccaggagcgggggaggagaaacgagagcgcaggacgcgagccgcgcgcaccgcacaggcacagacgcgcgcggcggcgcggcggccgcaccaccggcggcacagccaccaaagctgcaagcccgccgagcacgcgcggagaccagcccaccacccagcgccaccgcccaagcccagcaggaacagacgagagcggaagacgagcagcaggagaaggagcgcgacagcgcgacgggcaggaggaagacgcagacgggggcagcacagacgcgcacgccgagacggacacgagagaagagaaggagaacacagatcacacgagcacccagccccacgcgcccaaccagcaagacgacgcagcgcgagagacgcgcacacgagacacacgggcaggcaacgacagcagacgcgaacgcgcacgaaggcaagaacggaggcagcacgtacacgaacaagacagcagagcgggggcggcccaagcgcggcggccgaacacaacgcgaggcggcggcgcggaagagacgaggccaccacgacgcgagagagcacgaagcggacggcagagcagaccacgc

SEQ ID NO: 73648 - DNA, 1039 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggtatggtccacgtaaacatgt

SEQ ID NO: 73649 - DNA, 1738 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73650 - DNA, 1649 bp, Homo sapiens
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgccgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73651 - DNA, 951 bp, Homo sapiens
  misc_feature (502)..(502): n is a, c, g, or t
ctctaattctagttccggtctctatggcggccggcggaggcaggaacggttgtaggtcgactgaattagccgccaaaggtccaatgagaatggaggactgataaaatattagccaatagaagctagggattggggtcaggtgggcagattgacagtaccactggccagtgaacaacgcctagggcgggtcgctcgtagggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgccgggtctgctagcgtgaccacgtgcactacgggctggtgtgaacgcagtggagcgtgtggccccgtgcggccttactttggcggggcctgccgttcggggacnagaaggtcatcgcaacgaaaggttttggacgcacgtacaatggttcaatgtaaggaaccggatatggtttcatcaacaggaaatgacaccaatgggaaagatgtatttgtacaacccagtatgtgccattaacagacagaaattacaccccccgaggaaagtttaccctttcgcaggtgttacggacgattcggacgcagacttggtggcacgtttcggcctgcatcggttcggaacggggacgaaaaacaggcgttgccgtgaagcgccgtccaaaaagttgttccacaaaggttccggttgatgggatgttcacccaggttcaaagggacacgttaatttatttgcaggccgagaaccaggtaacccaatttattagacgccttattacaacgatcggtaggcacggtgcctcacaaggacagattaccccatcaacatttcccgta

SEQ ID NO: 73652 - DNA, 1393 bp, Homo sapiens
ataacgggcatatagtcagaccacggcgctcgcccacgcgtcggcgggagcggagagcggaccccagagagccctgagcagccccaccgccgccgccggcctagttaccatcacaccccgggaggagccgcagctgccgcagccggccccagtcaccatcaccgcaaccatgacaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgt

SEQ ID NO: 73653 - DNA, 395 bp, Homo sapiens
ataacgggcatatagtcagaccacggcgctcgcccacgcgtcggcgggagcggagagcggaccccagagagccctgagcagccccaccgccgccgccggcctagttaccatcacaccccgggaggagccgcagctgccgcagccggccccagtcaccatcaccgcaaccatgactgatgtgccctgatggaaaaaaaaaaacccccccccccccccccccctaaaatggcagtgcgcgtgctctctgtctctgatatcccgcacaccacaccccctgggactcctggagccgactccgccgatggtcacgccgccatttccgaaatggtacgggtccttcatatgggccgcctggggtaatgctaatccacctaaatatgggtcgttcctcctgg

SEQ ID NO: 73654 - DNA, 1529 bp, Homo sapiens
tgatacggatcatgtatttgtgtgaccaccactaccacagtcaatttgtagagcagttaaatcactgccaaaattccctcttgcttccttgtagtcagtccttctcccaaccccaggtacttggcaacctgttttccgttcctagacattttccttttccagaatgtcatattcgtaaaatcatttaacattgtagtcttttgagcctgacttttgtttttgagacagggtcttgctctgcagtgtgggctagagtacaatggtacaatcatggctcactgcagcctcgacctcctgcgctcaagcagtcctccctgccttggccttccaaagtgctgggattataggtgtgagccactgcacctggccctgagtctgacttcttatttaaatcatttgagattcatctgtgttgctgtgtgccatcagtaagttagttacttttattgtgagcaatatcccattgtatggatgttccagtttatcccttactcagttgagagacactgaaattatttgcagttttttggtaattatgaataaagctgctataaacctttgtagacaagggtttgtgttaacataagcttttattttagtgtgatgtgggattgctgggtcatgtggaaagcatttcttttaactttatactgccatacatatgtatttctaatctacagaataagctcatgacataaattatctctgtatatattccagaaatcaagactcaaaaggttaattaacttattcgtgtacacatagcaagtggctgagctgggattgaacaaaagtctaactccgaagcttgggtcctttccactatgccctacttcttccacgtaaagaagtcatttgactttaaaattatacagtagccttcataatgttcttaaatttcctgaaacaagcaaagttttgaaagtcgcctgtggtttcttaaagctggatttctcacagtctctccatttatatattgccgcatttacgtatactgtttcttagttgggctttactttctttagacttctatgtatgttttccaaatctggtttgcataaggtgactcatacaagaatgcttctaaacaaacaagccgtatatgtttatgtaaatgttacattttaaaaatgacattgcataaagaaattttgttcctgttatctgaaaaattttaggatatgaaacattgaatactttgaccatgacttgaaagcccagctgaatagagatctaataactagtaacaacttttattcaaagggcattacttacaggttgtttattggtcttcttttgtgctcagtttatatctgctctgaaatatgagccatgtcttaaaatttgataatgagctgaggataatttggagaagcaaaggagaataagtacttgtaggcttgaatcaattgatcttatttgttacttggaattaaggtgtaaggagtactccaaagtcacaaatgacttctagattgaagctatagaataaaggtttgcaggccaataaaattgaagctctctgaaag

SEQ ID NO: 73655 - DNA, 1355 bp, Homo sapiens
ggaggtgttctagaggatcccgtctgccattatccaagcttatatttatttatttatttatttatttagtatttttagtagagatggggttcaccatgttagccaggctggtctcaaactcctgaccccaggtaatacacccaccttggccttccaaagtgctgggattataggtgtgagccactgcacctggccctgagtctgacttcttatttaaatcatttgagattcatctgtgttgctgtgtgccatcagtaagttagttacttttattgtgagcaatatcccattgtatggatgttccagtttatcccttactcagttgagagacactgaaattatttgcagttttttggtaattatgaataaagctgctataaacctttgtagacaagggtttgtgttaacataagcttttattttagtgtgatgtgggattgctgggtcatgtggaaagcatttcttttaactttatactgccatacatatgtatttctaatctacagaataagctcatgacataaattatctctgtatatattccagaaatcaagactcaaaaggttaattaacttattcgtgtacacatagcaagtggctgagctgggattgaacaaaagtctaactccgaagcttgggtcctttccactatgccctacttcttccacgtaaagaagtcatttgactttaaaattatacagtagccttcataatgttcttaaatttcctgaaacaagcaaagttttgaaagtcgcctgtggtttcttaaagctggatttctcacagtctctccatttatatattgccgcatttacgtatactgtttcttagttgggctttactttctttagacttctatgtatgttttccaaatctggtttgcataaggtgactcatacaagaatgcttctaaacaaacaagccgtatatgtttatgtaaatgttacattttaaaaatgacattgcataaagaaattttgttcctgttatctgaaaaattttaggatatgaaacattgaatactttgaccatgacttgaaagcccagctgaatagagatctaataactagtaacaacttttattcaaagggcattacttacaggttgtttattggtcttcttttgtgctcagtttatatctgctctgaaatatgagccatgtcttaaaatttgataatgagctgaggataatttggagaagcaaaggagaataagtacttgtaggcttgaatcaattgatcttatttgttacttggaattaaggtgtaaggagtactccaaagtcacaaatgacttctagattgaagctatagaataaaggtttgcaggccaataaaattgaagctctctgaaag

SEQ ID NO: 73656 - DNA, 396 bp, Homo sapiens
tgatacggatcatgtatttgtgtgaccaccactaccacagtcaatttgtagagcagttaaatcactgccaaaattccctcttgcttccttgtagtcagtccttctcccaaccccaggtacttggcaacctgttttccgttcctagacattttccttttccagaatgtcatattcgtaaaatcatttaacattgtagtcttttgagcctgacttttgtttttgagacagggtcttgctctgcagtgtgggctagagtacaatggtacaatcatggctcactgcagcctcgacctcctgcgctcaagcagtcctccctgccttggccttccaaagtgctgggattataggtgtgagccactgtgcccagccaatatctttattttaatttgtttttat

SEQ ID NO: 73657 - DNA, 363 bp, Homo sapiens
  misc_feature (22)..(22): n is a, c, g, or t
tagagaaagacgaaactgaacntaggtctaagcatcagcttccccagcttttgaatctcactaggcaagggggacagagctccctgttgtggtttataacaactgtgataacagacacccagactcccctgcaatccaaatactgttggcatgaggacacttgcattctgtatggaaggaattaagtgctaatctgtggtgccataaagaaatgtcttctctttgtagggtgtaataatgatctctgctgtgttagcaaggtcagtgctttggacttctaggactagtagcctaaacttgtacgagttttagatgctcaggaacactacttcttattctttcttctctcttctcttctgttct

SEQ ID NO: 73658 - DNA, 649 bp, Homo sapiens
gggaagaccacgctctgatgcacttaccctgaccacctcccacctcctgagctggggctgggtctgcaggggggcagatacctgaacaaaactggagttttgataacaacaaagaaaatacaattttacttaaagtgatccaaggggacactgagtcagccattcatgaagctgaacatcatttcaagggacgctggctccggtatcatggtgaacgccaaggtgaagagcagccgcatgagatcccaaaggaaagcccgggagtcacacaagtggagtacagcagcaaaccccctccaccgcctgcccttggctttggtcttgccagggaacagctgatgccgactagatgacgcaaccaggaagtgaatatcctgtctgctccttgttctgtgctgtctgtgtgtcctagcttgccatcccaaatcaaggcatcccttgaaatcccctgggtccaagcatccagatgctcagtgaacgcagtgctctaactccatcttccactttccattaagaagtcaatgactcttattcaatacaactccatcttctgctaacccctaaaaggaatttacattctgctcatttcacttcccattatattgtattaattttcccatcattaaaccttttaaacccaataaaaaaa

SEQ ID NO: 73659 - DNA, 273 bp, Homo sapiens
agatctttaaccaaaaaaaaaaaaaaagaggccctacagaaacttagaaacagcctttacagggtcaaggggagctttgacaaggaagaggcaaaaatctctgccccatgtgtcagttgaacttcttccaccttccctcaccagtggctacatttcagggctgaaagggctttggaatcctttgctgagtgctttggatgagatttgttttcaagttgctttttagaattagagtgaccatttacatggttttcattcccaatctgtgaattc

SEQ ID NO: 73660 - DNA, 808 bp, Homo sapiens
tttttttaatttttgttagggccatataaaacaaaaaccaaaaacaaacttgcaactacgaaggttacagaaataataggatattatgaatagtagaatgttgtactattttgattattaaaacctggaaatgatgtccttatgcttggtaggctggtacccttaggcatttccctaagaaactaatcccacaggagtcaaaataaatagaattttctgctgctctcaaattatcatagatgttgtgaaaactgtaataggacaaaaaaaagtagtgaagacgaagatccaaaaactgaattccctgcatttccagtaactagcaatataaacagcaaaacagagtaaaagtagtttttgtgaaaaatgtaaattttccatctattgtgatggcacattgcaggacaaggaattctgtgagagagaagtctaagttcagatctgatttcagtatggctttgaaattaaactgcagaaatctcttttattaaatggaatatcactacccaccctgctgtactgtccatgagatttagctaaagtgtatgtaaagcacttaacagtgtggcacatataggcattcaatatatttttctgcattattaaagaatgtaacacattttcttgttctaaacatgtgggtatacttaagttttcattttcacaaatgctaaagcaacaactaggtagcaggctttcggtttaaataattcaactataatcacattctaagacatgtaactgattatcttccagaatagccacaaattgagtatatgagagaggtcaattttgagagctgatgata

SEQ ID NO: 73661 - DNA, 456 bp, Homo sapiens
ttcaggtagaactggcagaaagaattttttttccagtagtagtagtattagtggagttgaaaaatatacttttaattatacattgcaagctctgattgcaggttagaaaactaaaatcgatcattcctacatcaatagtgttgtctattactacattgatttgtgtttatttatgcagagactttcagttatttacttacatatttcagcatctgcctcttgattattatcgtaggttgcttttaatgaaagagcttatataggaagcgaaacacacttgacagatccattttaagtaaacctgatagtgaattatggcaacccaaggagattatgaaattacttattcatacttgctttttagcaattaggaatctgtttctgattaaaacctcatgctgcttgaaaacttccattcttttcttcatacattgtattgatgtgcttcaataaaat

SEQ ID NO: 73662 - DNA, 295 bp, Homo sapiens
ctagcctggcaaacatagtgaaaccctgtctctactaaaaatacaaaaattagctgggtgtggtggcacacgcctgtaatcccaggtactccagaggctgaggcagaactgcttgagcccgggaggtggagagtgcagtggcataatcacggctcactgcagccttgacttcccaggctcaagtgatcctcctacctcagtctcctgagtagctgggactacaggtgcttaccaccacacctggctaactttttttatgttttatgttttgtagagacaggggtctcactttgaa

SEQ ID NO: 73663 - DNA, 1081 bp, Homo sapiens
  misc_feature (400)..(400): n is a, c, g, or t
atggcgggacacctggcttcggatttcgccttctcaccccctccaggcggtggaggtgatgggccaggggggccggagccgggctgggttgatcctcggacctggctaagcttccaaggccctcctggagggccaggaatcgggccggggtttgggccaggctctgaggagtgggggattcccccatgtcccccgccgtatgagttctgcggggggatggcgtactgtgggcctcagactggagtggggctagtgccccaagacggcttggagacctctcagcctgagggcgaagcaggagtcggggtggagagcaactccgatggggcctccccggagccctgcaccgtcccctctggtgccgtgaagctggagaaggagaagctggagcaaaacccgnaggagtcccaggacatcaaagctctgcagaaagaactcgagcaatttgccaagctcctgaagcagaagaggatcaccctgggatatacacaggccgatgtggctcaccctgggggttctatttgggaaggtgttcagccaaacgaccatctgccgctttgaggctctgcagcttagcttcaagaacatgtgtgagctgcggcccttgctgcagaagtgggtggaggaagctgacaacaatgaaaatcttcaggagatatgcaaagcagaaaccctcgtgcaggccggaaagagaaagcgaaccagtatcgagaaccaagtgagaggcaacctggagaatttgttcctgcggtgcccgaaacccacactgcagcagatcagccacatcgcccagcagcttgggctggagaaggatgtggtccgagtgtggttctgtaaccggcgccagaagggcaagcgatcaagcagtggctatgcacaacgagaggattttgaggctgttgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactga

SEQ ID NO: 73664 - DNA, 400 bp, Homo sapiens
caatggaattttttttttaagcaggaagggcaggagagtggagacagaaataaaccttttaaatcttctttacgtgaaccccacaaggacataagcatttagcagattagagagcgtttggatttatagatactatcctctacagtagtggtcttcaatgtgtgatccagggaccccctgcggggccccaaggccctctcagaagctccaagagataaaaaccagttccataacaatactgaggcattgtttcccctttttactacggtgaccatttgtattaatggtgcaaagcattggtgggtaaaactgctggcaccttagcaggaagcaggacggtaatgccaagctgtaccagcagtcatggtattcttcattactgtgcagttgctgttaaaaa

SEQ ID NO: 73665 - DNA, 193 bp, Homo sapiens
tgagatggagtttcattcttgtcacccaggctggagcacaatgcacaatctcagctcactgcaacctccgctgtcacaaataaacatcagtaagagccagcagttgctctaggatctcagtcagcaagcttgggggctgtcaggaaaccagcagtcacctgtttctccctctcccagcccagggctgacccct

SEQ ID NO: 73666 - DNA, 338 bp, Homo sapiens
taactcatcagtcatcattaatgttagtgtattttatgtgtggtgcaatacagttgttcagtgtggcccagggaagccaaaagcttggacacccctgctgtagatggtgactgtttttcacatgggtccaggccagcagttctgaaatgtatgtacacacgaggattgaccacacaggtaaatctaatctgcatcggacagtgagagccagagggaggccaaggaaagcccttggtgttgggttggctccaaggtatctgtgtaaacccatggtttttaccatgtatatatgcaggtagatacaggaataaatgcagaagcctgcctatgcttgggct

SEQ ID NO: 73667 - DNA, 312 bp, Homo sapiens
tagttttagtacagatggggtttcaccatgttggccaggctggtctcaaacccctgaactcaggtgatctgcctgccttggcctcccaaagtgctgggattacaggcgtaagctactgtgcctggcccaaagtcaggattcttaagggaactctccaggacatgcttcgtttctctcagtctgtgtcatttagggtggcagaatggtctcacagggttaacatctctggaagtaaaccatttacccaatatgatgtagtggagttagaaaaaacaacaacaacaacaacaacaaaaaacccaaaaaaactag

SEQ ID NO: 73668 - DNA, 307 bp, Homo sapiens
gtgaaatctttctattttcccctagctaatctttattaagtatatgtaaatatttcagagactttttttttaatctgccttaaggcatttcaattaatactgtgatgtatcccagtgaacactttaccttccaagtgtttactagaaattttctaattttcacgttggcactgagggagtctttaatacataacttacctttcctaactcttcaggagtgcacaatcagagagttgggttgttttagaactgacaaagggctcggggagtttcaaatcaagtcttcttatcttacagataagaaact

SEQ ID NO: 73669 - DNA, 384 bp, Homo sapiens
gctttcaatacaacaatgatattatctcaaaatactcagcatgtctaacaggcctcttttaaaagctcagcatgtttaatgtagatgttgctaacgtccaggtggctcctataagttaagggtccattgatttagaagttctaaaagagactaacctaagggataccaagaacagatatttttaaagaatttcatagaggagatacacattagaaacccagaactctaagatgtgcatttgctaagtcctgtaaacagacaggaaaacacatttaaattagtttgccctttaaagattatttactacttgtctcttatcaatgtgagtacataaaagagaccttattacaattaaaaacaatgatggtttagcagcagatttag

SEQ ID NO: 73670 - DNA, 490 bp, Homo sapiens
caacaaaggcataaacagatgctctaatagctccttcctccaccctggtccctgagcccttttgccacagtttgactttcctcctgcacgtggaggactccccatgtgcctgctccttccctagtggctgggtgggcctcaccccacctccctccagaagcccctctgccaagtggtcacctcactgtgtctacatgccaccccccgtccccctgtccagaggctgcccctccccactggagctcaaccccaactgggcatctaggtgtgtccctgtggcccagctagtcctagtgccgtcctcatcatgtcacatcacatgacatctggatccatgacacccattaggctgggccctccacttggagggatgccctagaccctcacatttgggcaggtcctgaggcccatggtcttctccctggctgctgcctcactgctgtccttcctgggactccaaggccacttttctcaggcctaatggctgtgg

SEQ ID NO: 73671 - DNA, 444 bp, Homo sapiens
tgatggtgcagcatcacctttttagtatgctgcttcacttactggatgagtagctagtgtagcagatttaaaagtgtgagatcaaaagctgaatatagatagaatgatgacgttgggacttgattttttgacaagtatttgatggtgtgtttctttggtgtatttgatggtgtgtttctttggtttatttgcatctttttcaaaggtgaaatagagcatatgtagccataaaggtgtgtggttctagattaattttcacaagctttcttctgtaaaatttcatattataaaataaattgaatcagaaatatggaaaaaagtgaaaatatcacccccccccccccaatactgctgtcctccctcctcccaaataatactgtttaagcatagtgtctggtctctggtgatttcctacatacaattcaagatttgcccccaggtaaa

SEQ ID NO: 73672 - DNA, 408 bp, Homo sapiens
aaacaaaattatgggagcccgttattttggactgaactcctgtactaggccccaacagacgagaccaaaccaaaatggagtcattcatgctaaatgcctcgtcatcaaatagaagctttaaggaagcagatagatccaacatagactagtttttcttgagaacagaagattccagtctacctgtgtcagtgcaataaggaagtcctctctgctttaatttttacacaaaaagtaacctcatgttagccaatccgactttaaaattttttttttcctatttccttgttctcaccttacaaaacccactgttctgctgctgtccagcaggaaccctcatgctattttgtagaatggaagctgccctgattcatgaattgcaaataaaagccaattagatctataactata

SEQ ID NO: 73673 - DNA, 696 bp, Homo sapiens
taaaattactggcactgtttgacagtcaatacaggaaaaaaaaaaaaaatatgtcctggaagagaattgagaaagtgccttaaagagtaactggatgcctccgaaaaattcttaagcctagtagggtctcagaaaatgttactgcaaaatgaagtcctcagaagcagctctctctctgaccttctccaaacctcctgtctctggaccttcatttccacccatctcctcctccccaccaccgccaggctggccatgcgtactagactccctcttcctcaaggcaggtcatggaaaccagaatccctttccccaaagccagccacaaagcatcaaatattgtttctacttcccccagctcccctccagcctttctgtgtaaaccgtatagaaattatctgacctacctggtttaagtgtaggtcataacactcccattccagagaaggtcctgccccatgcccagatggaacgatggagtactgcacagagtccaggaaggatctaaaccggccttgctgggcttcctcacagtctattagcattacatcataccctttttgtctaattatatttctacagggctgtccatactttgttgaacctaagtataaaaatggacaatttccccctctacctttgggtcttcattctgaagtctcctgtgtcacataaaacaagatcaaataagtgtgtatg

SEQ ID NO: 73674 - DNA, 993 bp, Homo sapiens
atgtggatatgatagcactggacacttcgaggctccattggcaaaacatgcggcaaataggaaaccaagggacctttgacatttaagaagtatatgccctaagatttctacagatcctgaaattcatcactacggcagaatcacgcatcttatgaaaaccaagaataaaatgacacctgacaaccttgccagctcagcacatctggaggcactaaatgtctgacccaggaaatgtgcatcaaactgacgggtttcacaaatgagcagatcaagggttctccaggaagacctgccatgcatagacacctctacattagtgcagtcaaggatcaggaaacccctttctaatttgagcaacacacatatgaaggaataatccgatgtactgctgcaaagtgtcttcagccaatttagacaagaacaactcttaaattatttttggtgaagaaagttaatcactgaacaatttgaggtgaatggaagttcgctattcctctacaaccttttaccaggttataatgaaattgagtccactgaggaaggaaaaagttagtttcacttgactaagttcccacatggattaagcagcagacccaagaccaagaccagaacgcaatccactctttgatgagaacatacttggatatgacctatgctattttgaatgaaatttagcaaggaagaactgtccatcaatcattttaaccaagttcaccttttgttgccatttaagtttaattttgtcccaggaaattcatagtgagtgattgtgattacattttcctcattttcatgcctctgacattcttgttgaagatgctaatcttgtataaagctgtctttggagttgatgatgctgacacttctcactcctatgggaaatggagagatgtggtgcataaaatagaataaaatgtattagagcaaaataaaactgctaataagagtaatcactgtaatagattttaaaatcattttaaatctagttttaat

SEQ ID NO: 73675 - DNA, 1170 bp, Homo sapiens
taaaattactggcactgtttgacagtcaatacaggaaaaaaaaaaaaaatatgtcctggaagagaattgagaaagtgccttaaagagtaactggatgcctccgaaaaattcttaagcctagtagggtctcagaaaatgttactgcaaaatgaagtcctcagaagcagctctctctctgaccttctccaaacctcctgtctctggaccttcatttccacccatctcctcctccccaccaccgccaggctggccatgcgtactagactccctcttcctcaaggtgaattgactgctggggaaatgggctcagaagattaaaggcctgcttattaatggaaagagcttcctcccacacacagatatataaagccgcctcgccatttcttccttccaccgtgacccatagtctttctgggacaagggctgagatttcacagccgagttttaaagttgctggggatgctaacaacagggacttttatgcttgaatttctgctgcaaatcatacacccttggactcagtccactaagtctatagaattatctgcaaagcaatgcaataggatatacaaattttttgactatttgtatcgaaaataaatcaggaccttgaactatataaaaagctaacacattatcatgaaaactctgcatgaatactgataaaacatactggatgccctttgactcttacagtccttgttctcatctttttgcttatatccatttctcttttcaattaatttgggataattttgcttgaataataatctgatagtaacttcattatttctaattatattatcttaatgtgcaaattcaatcatttttggcttacattaacaaagataaaaatgtgtgacagaggttagtaatagaaggttagttttacatgaaatgaggaccagataaaagaccagtacaatgttatatatttatgtccttcacatgataggcagacatcaatccttgatgtcatgttcaaataaaggacttatatatatgcatagtgacaaagcactatgcatatgtatatgcatgggaacaatggagagaagttcagtgagagaattcccaattgtattaattactacaaacatttattgaataaagaatgataagaaacgcctctcttctttcttcctttcacatacacgtttacataaataa

SEQ ID NO: 73676 - DNA, 1140 bp, Homo sapiens
atgtggatatgatagcactggacacttcgaggctccattggcaaaacatgcggcaaataggaaaccaagggacctttgacatttaagaagtatatgccctaagatttctacagatcctgaaattcatcactacggcagaatcacgcatcttatgaaaaccaagaataaaatgacacctgacaaccttgccagctcagcacatctggaggcactaaatgtctgacccaggaaatgtgcatcaaactgacgggtgaattgactgctggggaaatgggctcagaagattaaaggcctgcttattaatggaaagagcttcctcccacacacagatatataaagccgcctcgccatttcttccttccaccgtgacccatagtctttctgggacaagggctgagatttcacagccgagttttaaagttgctggggatgctaacaacagggacttttatgcttgaatttctgctgcaaatcatacacccttggactcagtccactaagtctatagaattatctgcaaagcaatgcaataggatatacaaattttttgactatttgtatcgaaaataaatcaggaccttgaactatataaaaagctaacacattatcatgaaaactctgcatgaatactgataaaacatactggatgccctttgactcttacagtccttgttctcatctttttgcttatatccatttctcttttcaattaatttgggataattttgcttgaataataatctgatagtaacttcattatttctaattatattatcttaatgtgcaaattcaatcatttttggcttacattaacaaagataaaaatgtgtgacagaggttagtaatagaaggttagttttacatgaaatgaggaccagataaaagaccagtacaatgttatatatttatgtccttcacatgataggcagacatcaatccttgatgtcatgttcaaataaaggacttatatatatgcatagtgacaaagcactatgcatatgtatatgcatgggaacaatggagagaagttcagtgagagaattcccaattgtattaattactacaaacatttattgaataaagaatgataagaaacgcctctcttctttcttcctttcacatacacgtttacataaataa

SEQ ID NO: 73677 - DNA, 336 bp, Homo sapiens
atcctttgccctctttttgatggggttgtttttttcttgcaaatttgtttaagttctttgtagattctggatattagtcaaatagtttttttgagatggagtctcactctgttgctgaggcaggaggatcacttgagcctgggagatcaaggctacagtgagccatgattgtgccactgcattccagcctgggtgaaagagtgggaccctgtctcaaaaacaaacgaagaaactgttagtgactttactgaacttttgatattaatcaggtgccttcgcagcagagtctcttggattatactgccttcatattattcaacaactgaataaaaaaac

SEQ ID NO: 73678 - DNA, 452 bp, Homo sapiens
atacaaatattagtttgaaatgaatcatataactaaatataaaagctagaactataaaactattagaagaaaacttatacatacatctttattatcttggattaggcaacaatttcttagatatgacaccaaaagcacaatcaacccaagaaaaacagatttggccttcctcaaaattaaaaactttagtattaatacatcaaagaacactatcaaaaagtgcaaatacatccaccgaatgggagaagatatttgtaaattatatatatgctaaggatctataatccagattataaagaattcttacaactcaacaataaaaagacagcccatttttaaaaagggacaaatgatttgaactgatatttctccaaacaagatgtataaatagccaataagcacatgaaatgatgctcaacttcattagctattatagaaatacaaatcaacac

SEQ ID NO: 73679 - DNA, 5010 bp, Homo sapiens
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggcctgatcttactcatttacttcttcttctatgcctccttggctgctgtgatcaccctctgcatgtacacactatttctgaccatcagtccctatataccaaccttcacggagcgggtaaagcctcctggagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaaccagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatgggcaataaggaaggaggagtttggagaatgactccaaaggtttgagcttggctagaaccggtaagatggtgacattgttgatcaagactgggaatataagagagaagcagatttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaactaacctttaaaaagaaaaggaacaaaatgaaaaagacaataacttttaaaccacttgaaaattacctcaatcaaactctcaagattcagtagtaaaagataatagaatgttagatctggaaaggatattagagagtgtttagaaaaaacaacttgcattgcatctgactccaggtccagtgctctttctactctgagctgctgcttaccagaaagtaccatcttcttaaaaatcaatgaatgatatcccaaacattttgaaacgtatgtaaattttgagttaaaatagttaacatttcacaggaattcaactactggtgctatactttatacataatacattatcctgttaaatgcattgactattagacaaggaattatgaatcatttgtcaaataatatttatctttcaatggaatccattgtgtccacaattgcaaagcaatattgaagggtactaagatagtttgggttgtcagctaggacatgaaaaatgtaggtttactatacagaactggatatgataatatattcattaaagttatgttctaactgttcaatagacttctagtagattaatttaaatagttccccataccgtgctgcatcaggatttgatttgtatgccatctgttgcaatgcacttggttttacttgcttgtcaatgagaaatactacttccaaatgtcttcatggttttgtccatactggactttgggttatgatttttcaccttctactcccctgaaatcattatcctaaagtaactttttttaggcacctattttctggggatcaacatgtaaaaaaacatttatattgtcttgaggagttgtcaacaacaataaattgaaataaaaaagaaatgtatgattttctctttctagaccatatcactgattttcccactggaatattgggcagccatgtgggtggaaaacttgacaattgacaacctgttagttaaatattgtttttcttctctctcccctctttttgactcttagggtttagtcacaggaggataaaactaaaagttgtttcatttctgggcattttttcctttgtagtctctgtgctctggtttctcgttagactgctttgtgagagcagcctttctttatcaaggttgagtcctggtataaactgttat

SEQ ID NO: 73680 - DNA, 683 bp, Homo sapiens
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggtcagagttggagtaagtcccaatagtcccaatgccaaagtctggtgtcctttgcttttggtgtggtgttcagggctcctttaccatacgctggatgggcttgtctgcaaacttctctttgcacttcatgtaaaggcatcaatgcctagggaaatgcctagactgtggacagattccatcagaacaaactccaaatggatgaacaaacttgattgtgtaaccaaaacccactgggctcaacatcagttgcaatgcagagagacagtgagaatgagttgaaaaagcacatgatttttttaagtcccagtcc

SEQ ID NO: 73681 - DNA, 509 bp, Homo sapiens
ggaggaaaagtaaaatggtacttggcaaattatggttcttttcattttgattgcctggggggaaatggtttcatgggaatcaatacaaaaaaattatcccaagaatgggttaatatatccaagacctgttttcattgccaggagttatgatcagacccttcgcccatagccttaacttcaacttcaacgtttctgaacccgacacttggcagcattatgtgattagcctaaatggctttctccagggtaagtaagttcgtctgaatagtggaaagctcttttgaaaggtgatgggtgggaatccaaaattcaaaattcacctggcccaggaatcccagtcttactaaccccaactcatcatggtctgtccttactttgcatcccccttagcacctgtagctacaatcagaattgctctagtgtgtgattgtatgttgtcttgaaaacatacaagccaattttccagcaagataagctctttgtggcagagaaattttttttcttgaaca

SEQ ID NO: 73682 - DNA, 4235 bp, Homo sapiens
ctccagaactctcacccgattgcctgcctctgctgcgtctttgcccactgaacagccatgagaaggcaactccggtccagaagggctccatcctttccttacagttatcgctacagactcgatgatccggatgaagcgaaccagaactacttagcagatgaagaggaggaagcagaagaagaggctcgggtgacggtggtgcccaaatcggaggaggaggaagaagaggaggagaaagaagaggaggaagaggaggaaaaggaggaggaagagggtcaaggtcagccaacaggcaatgcctggtggcagaaattgcagatcatgagtgaatacctgtgggatccagagagaaggatgtttctggcccgaacaggcctgatcttactcatttacttcttcttctatgcctccttggctgctgtgatcaccctctgcatgtacacactatttctgaccatcagtccctatataccaaccttcacggagcgggtaaagcctcctggagttatgatcagacccttcgcccatagccttaacttcaacttcaacgtttctgaacccgacacttggcagcattatgtgattagcctaaatggctttctccagggttataatgacagtcttcaagaggaaatgaatgtagattgtcccccggggcagtacttcatccaagatggcaatgaggatgaggacaagaaggcctgccaatttaagcgctccttcctaaagaactgctctggtctggaggacccaacttttggatactctactggacagccctgcatccttctaaagatgaaccggattgtaggctttcgtcctgagcttggagatcctgtgaaggtttcctgcaaagttcagagaggtgatgaaaatgacatccgatccatcagttactacccagagtcggcttcttttgacctccgctactacccttactacggcaaactgactcacgttaactacacatcccccttggtggcaatgcactttacagacgtggtgaagaaccaagcagtgcctgtgcagtgccaactgaagggcaaaggcgtcataaatgatgtcatcaatgatcgttttgtgggcagggtaatctttaccctgaacatagaaacttaagaacttcagggggccattcttaccagttctgtttctgttttatctcatggtatctctggtagcacctgaattctttttcttcaattaggacacagccagatggacatctaagacagccgatcatctttccttgcctatgacatgtgtataaaatgacattgtgggagctgttcgattttttaaaggtagtgtctcctgatgacaaacagagtatattaatttcctttccctccacttaaaactaaagcctgttcttgctgctggtaatctccctgtagcgtaaacatagtatctgataaaatttacaatagccacgcaatagccatcaaggagaatttctattatgattataaattcatcatgttttctaaaattctgttggttttagaggtcagattcctcccaaccaggctaataacctaacacatgtttaaaaaaaatctgcctaagccgggtgtggtggcatgcatctgtagtcccacctattcaggagattaaggcaggaggatcacttgagcccaggaggtcaaggctgcagtgagctgcactgcattccagcctgggtgacagagtgagatcctgtctctgaagaaaaaaaaaacctgcctggcaaggtccttccctgggaatcaccactcggtccaacctagacaaccaagaccgctatacctaaagacctctatatcctggtgcctaagaaacttctgcctcccacagacaactaagtgcttattcaaagactaggttattttcaactgggaaaaaagcagtgctaacaggatattgttctgggatagagatgaagaccgtccttgtgactttttaaagaggtggggctcactgcaactggggagaacacttagcatatggatatgattggtgtttgattccttgctctctggtgtaatcgtctaaaggcaaacattcctgcaaacaggtttttctcagcttcaggcagaggagacaacatggaagaagattcccaccagctaattcttcttgggctatttgtttgacagtagcatgatgttttttgagaccatcaggggtggttacatagaccagcagctacagctctggaaattgaaatcataatctgtcaatgaatacatgacaagacagaacgttccttgccaggccaggcaaaagccaaggcccattagccagtttagcatttactttaaaaatgacatgaggcagattcttatccaggatgtggatcagccaggtcactttgtcttatctttggtcacctgatcactcaactgcttcttaacacctccaccagggggaaggctggcacaaggagaaaaaaaaagcaagcatcagcgaatagtatagtgtctcagggtccgaagcaagtttaaatgccacctaggaggatccaaagtctgaatctcctctacaatgtttcctttctcccaaaaccagggaactgactgtctggtagtgaagacaagcaagtggagaagttatacgatatagtttaatgagagttaaaaaactagtatgtggaaagctatgggaatatgaggaaaaatatcttgagctaagaaagtagcagaggaaatttcacatgcaaagccacagtcatgaagagaccatggtgtgtctgggtaactgtgagcagtttatgtaactggaatgaaaagggctcagaggaatggcagggatggcaagagatccagctagagaggtattcagggatggaaagaggactttgagttttatccaataggtgaaaatgagtaattaaagcattttaatcagggaggctctgtgatcacatttgtgttttattttattttactttattatttatttgtttatttttgagatggagtttcgctgttgtcacccaggctggagtgcagtggtgtgatctcggctcactgcaacctccacctcccggattcaagtgattctccagcctcagcctcctgagtagctgggattacaggcacacaccaccatgcccagctaacttttgtatttttggcggagacagggtttcaccatgttggccaggctggtctcgaactcctgacctcaagtgatccgcctgcctcagcctcccacagtgctgggattacaggcgtgagccaccgcacccggcttgcaatttagaaagggcacttggcaaccactatgtgaagggtgattggagaaggacaagactgtggaatgggcaataaggaaggaggagtttggagaatgactccaaaggtttgagcttggctagaaccggtaagatggtgacattgttgatcaagactgggaatataagagagaagcagatttggagagatcaattttgaacattttagacatgattttctattggtcagacattgatgtggagatgtaaacacatgtagggttggtgagaaggaaagatgagaacaaaagcaacattgggttaagggaactcgcttaagaaattttaagctatttaatcttgggaactgaagccagtcatgtaaacatactataccaatctagtccctaacagtgttttttctcttgtggcagaaagaattgctgttcctctttggaatctccttcccagacaccttcaaagtcttattgacacagtaaagggaggccaaccactactaacaagttctagaagatataggatcttctatagtaggttaatggaaaatacaaaaacaaacaaacatacaatgaaactgcctcctctcaacccattttcttaacaaattcaattttcaaaactaacctttaaaaagaaaaggaacaaaatgaaaaagaatttatattgtcttgaggagttgtcaacaacaataaattgaaataaaaaagaaatgtatgattttctctttctagaccatatcactgattttcccactggaatattgggcagccatgtgggtggaaaacttgacaattgacaacctgttagttaaatattgtttttcttctctctcccctctttttgactcttagggtttagtcacaggaggataaaactaaaagttgtttcatttctgggcattttttcctttgtagtctctgtgctctggtttctcgttagactgctttgtgagagcagcctttctttatcaaggttgagtcctggtataaactgttat

SEQ ID NO: 73683 - DNA, 273 bp, Homo sapiens
caagcacggtagctcacaccaataatcccagcactttgggaggccgaggccggtggatcacttgatgtcaggagttcaagaccaggctggccaatatggtcacaggaacctcaagtatttcacagaatgatgccaaggagcgcagtttctacaccatccctcccgatcagaccacatctattccaatctcagtctcaaactcttcccctttttcaactcacattaatgaattcactaagtacctagcactgagaataaaaagctaaagcagca

SEQ ID NO: 73684 - DNA, 241 bp, Homo sapiens
  misc_feature (49)..(50): n is a, c, g, or t
  misc_feature (56)..(56): n is a, c, g, or t
gggggttttaaaattaagtgaagagaagaaagtgagataaaaaaaaaannccttcnagggcaacgggtcacaggaacctcaagtatttcacagaatgatgccaaggagcgcagtttctacaccatccctcccgatcagaccacatctattccaatctcagtctcaaactcttcccctttttcaactcacattaatgaattcactaagtacctagcactgagaataaaaagctaaagcagca

SEQ ID NO: 73685 - DNA, 373 bp, Homo sapiens
tcctcccacaatgaccctgggggtcagatgttgagttagcggcaccacagaatggaagaagcctagattttgactcacagctttgagaaatgtccccataaaccctcatcagactatgcatggatgagaaaaaacttaatgactccagccatgagatctgaggaactgcttgttgctacaccagtctgtcctatacaggtcacaggaacctcaagtatttcacagaatgatgccaaggagcgcagtttctacaccatccctcccgatcagaccacatctattccaatctcagtctcaaactcttcccctttttcaactcacattaatgaattcactaagtacctagcactgagaataaaaagctaaagcagca

SEQ ID NO: 73686 - DNA, 257 bp, Homo sapiens
ggtatgtttttcctttggttaatttttagtattttctttgttagagtttgtagcattgtgttttgtattactaaatgttgttccacttgggatctgcaaattcctaaggtccttttatactctggggccctacaaagagaggaaccacggctgggctatttgaggagagaaattaggtgagtatgatccctcctgaggaatgttaactagaggagaggcagtggcctgaggcagccagtgagtgcagcagtgtactt

SEQ ID NO: 73687 - DNA, 491 bp, Homo sapiens
gtgaagggtttttgaaattagcacctacttgaaataataagctaaatctcatacttcaaggatggatttagctcccaattagaaataagagctagaagaaggagccactcagctaaaggtgataatgtaagtgcacagttttaaagttaaagataacataaagataaaactgttaaatgaatctaagtctactaaaaaaacagagacaccaaaattctatcccaaaaaattggtttagaaatctgaaaagaaaattaaaagattcatcttcaataacaacttgctacctcttatttgcccactatgatatatttacgtatcattcaatagtcaatgttctattttccatcctggttttctttgtgtttcagaaggcaatttcttttggaaaagaaatctgaggacttttgatacgcagacaacacatttaaaattcagctaattaggtaactactgaaatctctaactaactatttggggccagtgttact

SEQ ID NO: 73688 - DNA, 602 bp, Homo sapiens
gttggaagagttgctttaccccctcatctgacctaagaccagaacaagtacttctgtccctaagcaaggtctttttttttcttcaggcagcaaataatgatttgaccttaagccaaccaataatccaaccccttgcatctctgtgacattcttcttccacatgcccttcagctccgtttcttccctgaactgcaggatgtctctgcaaagcgcagagggtgcaggggctactggacctccaagaagtgatggatttggtctccaagttgatcccttaagagatggctgctgccctttgtgggtctcatcactgcaatcttctcatcctatctcctggctctgagtctcaaatgtttactggcccagggcaaggacccattcccatggtattctagattcatgccatccatctccgactgcactgctgggtggcaggacaatggctttgcatctgtgcttcatcccacagaacccagcttctgcctcagggaggaaccaactgtacttatttctctagattcttttcctccttcttgtggttctttctaaaaatagagacagactggcataaccaaccagcaatgagcactcctgtgcccgga

SEQ ID NO: 73689 - DNA, 3653 bp, Homo sapiens
tgtcccttcccttggtatccctatgacttacctgttggacaggtagggggaaggggagagtaatgagtctcacctgctcagagcaagggtggggcaagacacaccccatcccttccattggttttttccttagtcttactgacagagccttgtccaatcaggaggaagtaactttctatctgccaatagatgcaatgttaggatgagacctcaagttagagtccatccctagagccgactggcagtccccggggccaatggcaagcggataaacagaggcggccgtggaagaggactggaggcgaggctccgcccctccacgggacagtcaggcgagatagccagtgagctcgcaccagagggtgggcgtctcccccaggggcggagcttcgaggtggcgaggggcgtggcttggctgtcaggtctcttcgccttttgttcggttactgagttgctgccttggccagagtccggagcagccgccgcccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 73690 - DNA, 3951 bp, Homo sapiens
tgtcccttcccttggtatccctatgacttacctgttggacaggtagggggaaggggagagtaatgagtctcacctgctcagagcaagggtggggcaagacacaccccatcccttccattggttttttccttagtcttactgacagagccttgtccaatcaggaggaagtaactttctatctgccaatagatgcaatgttaggatgagacctcaagttagagtccatccctagagccgactggcagtccccggggccaatggcaagcggataaacagaggcggccgtggaagaggactggaggcgaggctccgcccctccacgggacagtcaggcgagatagccagtgagctcgcaccagagggtgggcgtctcccccaggggcggagcttcgaggtggcgaggggcgtggcttggctgtcaggtctcttcgccttttgttcggttactgagttgctgccttggccagagtccggagcagccgccgcccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 73691 - DNA, 3443 bp, Homo sapiens
tgtcccttcccttggtatccctatgacttacctgttggacaggtagggggaaggggagagtaatgagtctcacctgctcagagcaagggtggggcaagacacaccccatcccttccattggttttttccttagtcttactgacagagccttgtccaatcaggaggaagtaactttctatctgccaatagatgcaatgttaggatgagacctcaagttagagtccatccctagagccgactggcagtccccggggccaatggcaagcggataaacagaggcggccgtggaagaggactggaggcgaggctccgcccctccacgggacagtcaggcgagatagccagtgagctcgcaccagaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 73692 - DNA, 445 bp, Homo sapiens
gaagcggctctgaggccggaagtgagcctagagcgccgcggccccgagatgaagccggcggtggacgagatgttccccgagggcgccgggccctacgtggacctggacgaggcgggaggcagcaccgggctcttgatggacttggcagccaatgaaaaggccgttcatgcagacttttttaacgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtca

SEQ ID NO: 73693 - DNA, 1214 bp, Homo sapiens
  misc_feature (470)..(470): n is a, c, g, or t
  misc_feature (481)..(481): n is a, c, g, or t
gaagcggctctgaggccggaagtgagcctagagcgccgcggccccgagatgaagccggcggtggacgagatgttccccgagggcgccgggccctacgtggacctggacgaggcgggaggcagcaccgggctcttgatggacttggcagccaatgaaaaggccgttcatgcagacttttttaacgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcaaaaaaaaaaaaaaaaaaaaaaaaanaaaaaaaaaanaaaaaaaaaaaaaagggggggggggaaaaaatttccccgggggggggcccccaaccctagccggctacccccgatttgtggtgaacaagagggggcccctaaaggagggggcggctcgataataaaggacgacgaacaagaccaggggccgcgaggcggtaacaacaccgctccgtcgaggggggcacacacgccggcacgaccgggcgaccatcttcgcggaaagaagacaaccacactcaacgcgggcgcggggcaaccacaagggggcacacaacaccaccaaccggagagatgataacagcccctgcaggggggaacaactactaacattttgagagagggggagtataagggtggcggtaaacacaacaacggcgagtaatatatggcaggcggcggcaaggacaaaaatgttgcggcgcctagggggggaattattatttgatgagcaacactattattactaccccggcggggcgctagcagtgaaaaaataaaagagagggacaactagaactaacaacataacaccaagcagccgcagcgaagccacaaagcgcaactaccaacgacagcaccacacagcgcacagcaacaaacacagaagcaaccgcaagtacctccgcaacccaccgtcaccgcaccgaagcacatacaccacgctaccacaacacatccacagacacactacaaagagcaacaacaacgacgacccccatcaaaacgcaaa

SEQ ID NO: 73694 - DNA, 475 bp, Homo sapiens
gaactaaaatgttgactccaacttgagcctgtttcccctcacccatcttctttttttgtgggggtagtggccctgcaatgcacttatcacctgttctttcggaaaacgcacctgacataaccttgcctttccattccccaggcgggaggcagcaccgggctcttgatggacttggcagccaatgaaaaggccgttcatgcagacttttttaacgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtca

SEQ ID NO: 73695 - DNA, 499 bp, Homo sapiens
ttaggattgtcttttaaatgaaagctagaaagcactctagccaacactctccccttggactacatgtacgagccctggttggctgaaactgaaagtctgttacgggaaaagtcttttatttcattggatcattgacgattatctctgtattttggactactatataattcattctgaagtgatttcttcagcccttacccttgtaggtgtaactacgtggttttgcttatttccctagattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtca

SEQ ID NO: 73696 - DNA, 400 bp, Homo sapiens
cgttcatgcagacttttttaacgattttgaagatctttttgatgatgatgacatccagtgagatgccctctggctgcaggcggggccaagcccttggtacagagccgcagtgtgagcctgcgcaggacagtttcaggtgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtca

SEQ ID NO: 73697 - DNA, 1268 bp, Homo sapiens
  misc_feature (524)..(524): n is a, c, g, or t
  misc_feature (535)..(535): n is a, c, g, or t
ttaggattgtcttttaaatgaaagctagaaagcactctagccaacactctccccttggactacatgtacgagccctggttggctgaaactgaaagtctgttacgggaaaagtcttttatttcattggatcattgacgattatctctgtattttggactactatataattcattctgaagtgatttcttcagcccttacccttgtaggtgtaactacgtggttttgcttatttccctagattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcaaaaaaaaaaaaaaaaaaaaaaaaanaaaaaaaaaanaaaaaaaaaaaaaagggggggggggaaaaaatttccccgggggggggcccccaaccctagccggctacccccgatttgtggtgaacaagagggggcccctaaaggagggggcggctcgataataaaggacgacgaacaagaccaggggccgcgaggcggtaacaacaccgctccgtcgaggggggcacacacgccggcacgaccgggcgaccatcttcgcggaaagaagacaaccacactcaacgcgggcgcggggcaaccacaagggggcacacaacaccaccaaccggagagatgataacagcccctgcaggggggaacaactactaacattttgagagagggggagtataagggtggcggtaaacacaacaacggcgagtaatatatggcaggcggcggcaaggacaaaaatgttgcggcgcctagggggggaattattatttgatgagcaacactattattactaccccggcggggcgctagcagtgaaaaaataaaagagagggacaactagaactaacaacataacaccaagcagccgcagcgaagccacaaagcgcaactaccaacgacagcaccacacagcgcacagcaacaaacacagaagcaaccgcaagtacctccgcaacccaccgtcaccgcaccgaagcacatacaccacgctaccacaacacatccacagacacactacaaagagcaacaacaacgacgacccccatcaaaacgcaaa

SEQ ID NO: 73698 - DNA, 413 bp, Homo sapiens
gcttgataagcatgtgtgcactggggcttgctctcttggagcacttctgccaccatgtgaagaagccaggatgaaagacctcatagagagagacccagctggcttagctggtccaaccatccaagctgagactgtagacatgtaagagaagttgtatgatatcatccagccccagctgaatacagggatgactacaaacacatgagttaggcttggcaagatcagcagaagaaactcaacaaaaatttggcgaaactgttgctgtttcaaggcactgtgttttggggtggtttgccacacagtaacaagtaacttacatatctttattttctaaggaaagtaaaaggccttttccccctttcagtacaacgacctaaaaataactgaccaaagcaattatagatcataagaca

SEQ ID NO: 73699 - DNA, 453 bp, Homo sapiens
taaaaaagagcctttaagttcggttgccatgaatcatgtataagccattggaggagaaaattaattcttttgtttgtttctttattttaaaataaataccaggctatggcacccgtttgtgatcagaattgagaagaagcactcttcctgccagcttgtgggaatgctgtgtcccccaaggccaacagtatatgctgccaatgagtgaaaagaactaagactcaagtctgcacagaaaaaggcccaacatgcatgcttcagttttgatcccagcttggcccttaattttccaaacccttgcagatggagagctacctattttgggactgtaaggtttttgaaattaactgtcaactcattatccaaggcacatactatcttacctctatcttaccttctaaatattttaaataacgcttttctcagccttctcttttggcatctctttcttaa

SEQ ID NO: 73700 - DNA, 1131 bp, Homo sapiens
tggattattcctttctctgcctctggtacctggcacatactaagtactcaacaaatgttagagtagatgtttctagaaaggataaaccagatgcttaacatatttaattccaaggggtaattttagaaattattgtaatcaatgagctaataatatgttttcatgtccctaaaggaacttgaagtctaaatgggcagacaagaccaacatacacaaagcagagagtggcacaagagccatgtctgatgcaacagtgactcaggaggatcactctgactcagaatggccaagcaaaggtattgggaggaagtgggatagaactgagctttgaagaccgtgctaaaatatttacagactccccaggttatctcaagttctctccaggaattagcttcacctctttgtgctttggctccacatcagttaaatagtggtaacgtttgatcgttaagaaccatgtagagatgaaacaattttcaaagttttttaattaagtgtactcattgccactcaaagacaaataccatataaatataataataatcatattgagaaacaaaatagcaatgatgcagatactcatgtactgtttcatgtttgtggtctttgaggggagtttttactcaaatatccctagatgaataaatacatatggtctataaatatgtcccaaagcaattttctccacttgaacctacatatacttcactatagaactgaaaacaaatttatttaaaacttcttttatgtggttgtctgttgaaaaaaaaatcagaactctcattaaagccaataagaatttggtataaaaaattaatagcaggatatgagcttatagaatcttatcaataatatctttatgattcattggtctctttgtgatgtgccaaacataaccaggatttattgatgaatatgatatttgggggtataaaaactttatatatgtttttctttactcaattagtgaatcttgtctaaattaatattgtcatgagatttcatttagcaatggccaggtatcatggccaaatagatactttgacttgaattatctgcctaaatgttctaattctccactttacttcacgaaactgaggaaattcagctgtaataaaaatcttaaatttg

SEQ ID NO: 73701 - DNA, 1231 bp, Homo sapiens
ataggaagagaagattaagacacagagataccagagaggtcgttcacagaggaaagaccatgtgaagacgcagtgagaaggtggccatattcaagctgaggagagagacctcagaagaaaccaatactgccaacgccttggtcttggacttccagcctccagaactgtcctggatcagaagatgcctgacaagaggccactatcagcagcaacagcacagtggggacaaacctgagaccttgatggaccgtggacaccagcaggagagacagaggaacttgaagtctaaatgggcagacaagaccaacatacacaaagcagagagtggcacaagagccatgtctgatgcaacagtgactcaggaggatcactctgactcagaatggccaagcaaaggtattgggaggaagtgggatagaactgagctttgaagaccgtgctaaaatatttacagactccccaggttatctcaagttctctccaggaattagcttcacctctttgtgctttggctccacatcagttaaatagtggtaacgtttgatcgttaagaaccatgtagagatgaaacaattttcaaagttttttaattaagtgtactcattgccactcaaagacaaataccatataaatataataataatcatattgagaaacaaaatagcaatgatgcagatactcatgtactgtttcatgtttgtggtctttgaggggagtttttactcaaatatccctagatgaataaatacatatggtctataaatatgtcccaaagcaattttctccacttgaacctacatatacttcactatagaactgaaaacaaatttatttaaaacttcttttatgtggttgtctgttgaaaaaaaaatcagaactctcattaaagccaataagaatttggtataaaaaattaatagcaggatatgagcttatagaatcttatcaataatatctttatgattcattggtctctttgtgatgtgccaaacataaccaggatttattgatgaatatgatatttgggggtataaaaactttatatatgtttttctttactcaattagtgaatcttgtctaaattaatattgtcatgagatttcatttagcaatggccaggtatcatggccaaatagatactttgacttgaattatctgcctaaatgttctaattctccactttacttcacgaaactgaggaaattcagctgtaataaaaatcttaaatttg

SEQ ID NO: 73702 - DNA, 416 bp, Homo sapiens
cacttctattttcatatactctacaaacacttgttcaacctaagcttttctctcttctgtagtcaagtgtctataaacaacacttgggatcctagtttaaaaaacaaagttttagtctttatgataaaaatattaacataaatggataatgattatttcctcctcaccatgttagtttctcttggccagcagccctaaatatgtcgtattaactttaaatagtagggtccagattctaagacagtgtttcccaaatgacatcaagagatgtaagtactgtccctaaatgtgtgttgaacaatcaaatacagttggaaacactgctcgctcaattgccatccagaaaactgatggaaaatagcctatcgaaggctgtaaaaaaaagtcctgcaataaatgtttagcttcatttactc

SEQ ID NO: 73703 - DNA, 338 bp, Homo sapiens
atttctggctacagtttcaatatttaagaaaataaaaaatagacaaacagatggaaattttagcagccattttctaaacaacattttagtgactttataataatcatatagctacattatattattaaacttgatgatactaggttattttattcatgttatttttatattttccccttactgacacttaatatttattacatattgacaatcttctaagtactaaaacattatttcatttaataatcataaaaccaaacatgctattgtgttattacaaactgcagaataggaaaccgggaccctgaggagtttaagtaaattctccagagtcagaa

SEQ ID NO: 73704 - DNA, 599 bp, Homo sapiens
ctttttcttcccagtctccggtatgtcattatcagcagtgtgaaaatggactcactcccaccctgtctggatctggacaagagcccaccaccccgttggcagtagtcaggcagctctgcttctaagaacctgcagcttttggaagaaaggcaccctgtggtttcagaagcccaagagtccctgcagctcagcacccccagcctggtgcttggcagatgactgcctcctcacttagcagagggagcagaaaactgtgtattcttcagaacatcatgataacctggcactcatgggtctatggagagaattcagggggtctgggagcttggatggaataaatttgcatctttattttcaggaaagttttactgaagtttagcattttctttcattataaatggaatcagtataacccaatagtatgagcagttacttctccgcaacatcaaagtggctgcagatatctcaaaatagtatttacatttatcataacttagaaatttgggtggtaattaaaccagcaactattctttgtttaatgcattaagaaagaagtatgtatactatcatatctcaattaaaaatattttaagaactgg

SEQ ID NO: 73705 - DNA, 441 bp, Homo sapiens
gtctcatttccctgcaaatgtctgccttcgtgcaggtgattctgtagaaaggagtttctccaataaagcagagcttctctttcaactccatggacatcagagagagtccctttcaaaaaaggaggctcaggtctggagagacaaaggcctctactttcgaaaaggcctcttggatcaagcccagaccctcatcagagctgacaacatgtccagcctgcactactgcaagaacttctttgtctatggtagtgtggtcaactgaagaagccggcttagttgctccagtcaggtgctcacactaagaaaggatgggtgaaggttataaagtggctgtgaatgagaactcggtctgggctctaccaagcagagaagccatgcagagatgagaaaggtgaaagccatgaaaccatgttaagcagaaaaataaaaattcataacaga

SEQ ID NO: 73706 - DNA, 494 bp, Homo sapiens
tttccatggaaattctgtgtaccctaagctatgaaagcatcactgcagaactatttggattgccactgctggggcccactggtttcactaatgcaggaacaatttataggtgaatttatcaacttcgggggttttggtattatacttcaaatgtccatttggaatgcactcctacatgtggtacaggactgtggttctgacttcttgtaagtaacccctgattcttcttaacattttcattagccagtgggtgacatctttctagttcctattttacacacagagatgtcctttgtgactcccagctttaagcaggtagctcaattctaattctctgcacatttgtgccctgtggcctagaattcacctcacactcatgattagagccttagtcccccaactgcaaagccacacagcttcaatttctgttcactccctcactttaaatttcttcttcatttttgtcacataataaatttattttctggtttgag

SEQ ID NO: 73707 - DNA, 485 bp, Homo sapiens
ccatttttcgctttcttaatttttaaaaattaatgaggtttttgttgctattatatataatcagacaaaaagctataaaggaaaaaaagaattagtccacagacaagttttggttggagtccgacatttcacaagctgtgtattggccataagatggagtgtcgagtgaatagatgccacagaaatggcctttgaatggcgaatgaatgaagttgacacaagttcagaacgggtttttccattactatcgtttggaatacagtgtggccaaagccaaggcaactggtcactgtgactggaaattgtagccctggctgattgtggtatgagactgctaatatgaattctaaaatctcactttaatgcagcaaagcctatttcttgaagtggttggggagaaagtacagcacatgaaaatgatagagaattcacatttcagtgtatgtaaataaagacttactggagtgcagccacacttatgtgta

SEQ ID NO: 73708 - DNA, 835 bp, Homo sapiens
agcacaatcagaactcactgcagtctcaaactcccagctggtctcaagcaatcctcccaactcagcctcctgagtagctgggacaacaggtgcacaccaccactcaaggctaattttctttttatttttggtagagataaggtcttactatgttgcccaggctgatctcaaactcctggcctcaagtgatttttctgccttggcctcccaaagcactgggattataagtatggccactgttaccagccttagatcattttttttaatacagatagcttcccaactaaaaatattttattagaattctctgaattcagcaaagcaatgttattactgacccagtcttcacttattttcagctgacatggaagaacaaaattacctttatttttaaatttattttattttatattttcaaggtgcaaagtatgttgttttgagacacatatacataatgaaatgattactataatgaagaaaattaacaaatctatcatatcacttagctgtgcttcttttttatgataagaacaccaaaaatctagtccctcagaatatttcccaaaaacaatacattatcaaatatgcctacaggttgtacatcagattcacttattctactacgcctttacaacttttgcccttcatttacctatttccttcccaccaatgtaaccaccttttttaatgtattgaacttttaaaaatagatttcaaatatgagtggaaccatgaaaaaccacaacaaaacaaaacaaccaaaacactacaacaaaaacaacacacacacacacaacaaacacaaataatcgaccacacccaaaaacagcataca

SEQ ID NO: 73709 - DNA, 1510 bp, Homo sapiens
  misc_feature (5)..(5): n is a, c, g, or t
agcanatcggtactcacgccctatgaaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatt

SEQ ID NO: 73710 - DNA, 922 bp, Homo sapiens
  misc_feature (802)..(802): n is a, c, g, or t
gctggtacagggccgcggaagtcctttggatactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttgncctgcctccgctccagacgttctcgtgcccggcctgggcttcccgtcttgggctctccccctcccacccggtcccccggttctgccgccggaacggcccctgagggttccgccgggcccc

SEQ ID NO: 73711 - DNA, 628 bp, Homo sapiens
aggagggcaccaggcccgcaggacccttggggaggggcaggtgctgtgacccgggaacctggcacactgggcccagagggagctggcggagggagcgagcgcccagaggatgcagagaggcctggcactgagcctagtgtcgggagcaaggcggcagagtcatgcggcagccagcgcgggcagggacgcacgcgggaatcgagctggggtggcgccaccggagcaggaaggggacaggtcggtgcggtctaagctactccgtaaaagcagccgttgtgtgtctccgtgtgtgtgttaggggaacaagtggagagtgagtatatgtatatatccctcactccataccaggaggaggtctcctcaccccctgcgctcttcataaattcccatgctagggtctgggtaaagctgcgaggtacttttggtgctcaaattcggagttcctcctttagaggcaagattactcacctcctttgccagttgcactcctcccttccttccagactggcagtatgattaactcggtgggaagtgactgctaagtggagacggaaatcagtcaccgaactgagcaacagtcctgtgctcacttcccccaccccacgcctttgaaaactcttctctcggc

SEQ ID NO: 73712 - DNA, 1514 bp, Homo sapiens
gctggtacagggccgcggaagtcctttggatactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatt

SEQ ID NO: 73713 - DNA, 1591 bp, Homo sapiens
aggagggcaccaggcccgcaggacccttggggaggggcaggtgctgtgacccgggaacctggcacactgggcccagagggagctggcggagggagcgagcgcccagaggatgcagagaggcctggcactgagcctagtgtcgggagcaaggcggcagagtcatgcggcagccagcgcgggcagggacgcacgcgggaatcgagctggggtggcgccaccggagcaggaaggggacagatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatt

SEQ ID NO: 73714 - DNA, 1654 bp, Homo sapiens
cagcttgccagtgttcagtggatccaacactggagttgggcctgttagtagaaacaggctttattaacttttgccaggctctagaatggaggtagtttcatatcagacttgtagtgggcttgattcagaaagaagggtggctgagtagatggaagagcatagtatggcctttccctctgtgccagcttctccgtccctgctgcctcagtatacctgccagcctttttgcaccgaaggtcatttgtctgtgatgcccttggaatgggagcagaattcaccttgatattttttctcccccagatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatt

SEQ ID NO: 73715 - DNA, 663 bp, Homo sapiens
  misc_feature (5)..(5): n is a, c, g, or t
agcanatcggtactcacgccctatgaaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagataatacattccgaggggctcagttctgccttatctaaatcaccagagaccaaacaaggactaatccaatacctcttggattttatttaatgtcataatgttgtcagaataaagagaaagatgaaataatttcatt

SEQ ID NO: 73716 - DNA, 1319 bp, Homo sapiens
aagctagtagagctggtgtaaatcggacgagggttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatt

SEQ ID NO: 73717 - DNA, 1820 bp, Homo sapiens
  misc_feature (5)..(5): n is a, c, g, or t
agcanatcggtactcacgccctatgaaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtatgtatgttactccgttttttttaggtgggtaggatttaaagacttctctaggagctgtgggagaatttttaaaattccgtttatgtgagataattcaacctgtgtcctaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatt

SEQ ID NO: 73718 - DNA, 696 bp, Homo sapiens
atttttaaggagcaaattgacatttttgaaggaataaaggacagccaagctcagcggatggcagaaaatctaggcttcgttgggcctttgaaaagccaggctgcagatcaaatttcgaagctggataatctcttccctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgcccatggggatcaccaaagcctgccggggagctaggaacttcaaggtgcccctggtggttccggcttgaagggaaccaacgtccaagaggcccaggaagattattcaatcaaccagcggacttccccattacttcagcc

SEQ ID NO: 73719 - DNA, 289 bp, Homo sapiens
tggctcattgcctcatttggtaaatggtctgtatcatttgaattgcaaaatgtaccacaattgtttatatctatgctgtgatgttctttgattctagtagtactgtcgtttgtttatcgtgaaatattttttatattatgagaaaagtaggagacagcaaactaacatctgactttatgccttgaatgattatttagctgtatcttttttaaggactttatcctgtttcctattggaaaattgtgcaggatgattgggatccggttaacttgtaaccaggattgtctgc

SEQ ID NO: 73720 - DNA, 866 bp, Homo sapiens
tcttgctcatctaaagctccgataggagctcactttctgtgggacattgtttttgtctttccagcacccattctacccctccctgaggtgtgggaggctgctccagctccccaggtggcccctgaatgggctaaggtggcaaccctctatctcttgccacaggcctgagccagtcttggcgttcctccagcctcagtgacaggttcaaggctgcccaatcacaagaagctcaggattttccctgaggattctgggacacagattatggcccttgttgtgactggatgacactgatgacatggggtgggggggtgggggtaaaagacagacctcaggtcctcagtgacatcagtaagccactgaatgaatcacctaaccctgagacctatcctacttctggactttttacaagtaaacggccaataaatcccaccacatcccttgttttgatgtttaggccattttgggttttttgttgttgttgttgctttcagccaaaggcatcgtaactaacaacatctgttgggtggaagagggagaaggatcaactgcactatatacactggtttttttatttgcattttctccaagggcttttaacttcagaaatgtacaagtgatatgactccactatactttaaaagaccacctctgagcaacagctcttcccatgtgtaagatgagaagtacctgtcctgtggcctctcggctggtcacaggcagaagtgaatgacatgagtgtgacaatgttttatgaactatagtcttatacagtgatgagaactgttttccaaatgatctcattttaaaacactagctttccagatgctaataaaatcttacttcattctcagtaaactatcgca

SEQ ID NO: 73721 - DNA, 376 bp, Homo sapiens
ggcagaggctgcagtgagtccagatggtgccactgcactccagcctgagtgacaaagtgacactccatctcaaaaccccaactccccccaaaatttttgatttggtttgcatttctttgattatgtttgaggtcgattgagacttgaggctggcactggagcaggcgttcccacctgtcccgtgagggcaaaggtcgtggggagtgaccaagtgcatcagggggtgcagatgccctattctggctctttcacgctcagccatcttagcatacgtgaatataccatgagctgtttctcagcttgttttattttcctggtgagatagatgtcactggaatggcctttctccaagtgaaaggccatcttgtgctatgac

SEQ ID NO: 73722 - DNA, 440 bp, Homo sapiens
agaagtaggaacaatagttcccagtgggtgaaaccctgggtgtaagactggttgcataattttcagggcccagtgaatattgagaatgtgtagcttgggcaatgtaatgagacttcatctctacaaataataaacaaaaaattagctgggtgtggtggcactctcttgtggtcccagctactcgggaggctgaggtgggagaatcacttgagcccaggtggttgaggctgcggtgagctatgatagcaccactgcattccagcctgggtgacagagcaagagagtgtggactcccttgttcaaaaattattaagaatttcaaaacagtgaaagcagagcatcaaaccaagctgggggcccttctaagcatgcccatgacatacagtcatgcgaccctggagctagtcctggctgggtaggagaagggggcatgcatgtgc

SEQ ID NO: 73723 - DNA, 560 bp, Homo sapiens
  misc_feature (12)..(12): n is a, c, g, or t
  misc_feature (476)..(476): n is a, c, g, or t
  misc_feature (546)..(546): n is a, c, g, or t
taatgaaccccnggctgcagaatcggcacgaggaaacctttgcatttattcatctggactcccccacattgcagatgacgagacgggtacagggaggtccagccactcatttcaacaggtcagccagtagtagcagagcggggatcagaagccagctgtcgggctgaggcaggtgccctttctccacttcaaagcttttcctttgtctggcagggatgatctctctgtgtgcgcaccatggtctcagcctcagtctttccctccccgctgtgtccctcggcctctctgtccaccttcctcagtgtgtctgtctccctctgtgactgtgtgtccgtgtgtcttgcaaggcccctggctgtctcactctcacgctgcacacacatgtctatgcgctctttttaaccccacatccattgctgatgccccaaatgaaatagccacagggattatccagtatcccatgtcccaggtgcccngagccactgctggatagtagctccactccttttatgggtaagataacaatatgccgtcaatacccacagncagcttctgtttaa

SEQ ID NO: 73724 - DNA, 159 bp, Homo sapiens
caacattttaaggtcagggatgtcatcaagaatccagatattttccatctgttgactctgtattcctcagtatgtctgccatgtctccctcacacttacaaggtggctgcggcagttccaggcatcacatggtaacaagatcacatccagtgaagaagg

SEQ ID NO: 73725 - DNA, 350 bp, Homo sapiens
ctctgcagtctcttgagtaggttggactataggtgtgggctaccacacctgtgtgctaggtccaatttttatagcaagttacaacgaatctctgtaactatctgggtttttctagaaattttggtcttctagcaatttgacctcccgtctctcaccccatctccaaattgatacattattgtgaagtaacagttgtgacaactgccttctctcattctttgttcccatggcattttcaaactactctcattctagtatttgtgacattatgccaaaattgcttgttttgttcttccttccatccaaactgtaagttccctggggatgtagacagtgtcttgatactattt

SEQ ID NO: 73726 - DNA, 319 bp, Homo sapiens
aagggaagaagccagatcctgagttttcactgagaagaggatttgaacaacacagtggtggtcaacagcagttattggaactgtagattgttggttttgggaacacctgtctaggttgttaagagccagtggaataggacatcctggaaatgaagaaacatcaaaatccaaggaatctgagagaatgggaacaaaaaaacacatgtagagatttatggaaaacttgagacacaggggaagaaggataaaaatagaactcagatttctggaggtggatgacatttaactttaataagtaaagggccctgtctctacaaaa

SEQ ID NO: 73727 - DNA, 315 bp, Homo sapiens
ccaaaattacaagactgtttctgaaaatattccgaaagaatgtttagaaaacatctttttccaggtagacagagagtttgtgaggctgcatcattggcatcattttatcatcaccatcccgctcaggagctcaagaagaggggaactgagtcagttagaattacagagaaaaaaacatagtatatataaggttctggagctgaaaaatacaatgaacaaagtgaaaagtgaaacagagactatcagcagcagaattagtcaagcaaaagaaagaatctgcaaaattgaagatgagttatttgaaaatatacagtg

SEQ ID NO: 73728 - DNA, 447 bp, Homo sapiens
aagcaacaaataaaacgataatcttagattttgaagaatggaatgaagcagggtaagactttgtaatggaagatttaatacatatgacatattactatgtgtagtggtattaaggatgctgagaacacgtcagaagataggagtggctcctcattcagttaatttcttaaatgcctgctatgccccagacctttctatatacaggtaatcaagcatatgaattataagttgtttctaagaataaatgtcagttacatggaaatgaatgaaaggaacagtatgttttagtataacttttgatgattactcaatatgattataataaacataagctatttcattttttacctgcaatacagtaggcctatcaggttacagtagagccttttctcctgcattaaatgaccctagactaagcttatttaagcccttctgcttgttttccct

SEQ ID NO: 73729 - DNA, 488 bp, Homo sapiens
gggctccctctccttcccgaggcttggcaaacgcctggatcctacgttgacaatccagctacatttcagtgggactccagaaagctcacatatcccgctggtctcgaactcctgacctcaggtgatccacctgcctaggcctcccaaagtgccgggattataggcgtgagccaccggactgggcacattttttttttaaagtaataggatagcatctaataatcaatgcttaaacaataacaaccttgtcagtcaccagacaggagaaattgggatgtcagtgccagcacatgtgcagattcaggcaaatctctaagtttagatcacacaattttcaaagctaggaaaggttggtgattgtcatgcactgtgaagtatttcttagtcaaaagacagatatccaattaagaaggggaaagccacaagtttaataaaacaggagatgtggaaggagcctctgttcttcgctgagctctaaattataccat

SEQ ID NO: 73730 - DNA, 531 bp, Homo sapiens
gataggagtgttttggcagggtggttaaatgagaatgtttctaaggactcctccagtactatagttctgcagtttaatagaacatatatgccctgatataacttccagctattcattcattcattcaacaaacttgtttgtgtgagtgcctgttaggtgttactgtgctagccatgaaactagcaccattcttgtcctagaaataatataaaatatgtttgttaaatatgtagtaagcatttcataaatgctcttgaagggtgtacacaatagaggctataacagcttctctgaacaatcctgtggttaatgatgttctttaattatgccaacatccaatacctcatgttaaagacttttagcattttccagatgttggaaatgatcagaaaattgtatattctcagtaactatgaagaataatctgagttcttagttgtgggtgctgaggcccaagaggtatatccttcatcaaggttacatgtgggtagaggtagatgcctcctgcatcccagcattgggttagttagc

SEQ ID NO: 73731 - DNA, 438 bp, Homo sapiens
ttagaagtgggacttatttaagatgaacagtaaattctctgagtttgatttgtttcatttttgccacccccacccccaaacctcattgcttgtaagctcagaaagcatgcctatgcatcatttttgaaaggaaaataatgtggatatttaataatgtggatatttaatagtgtggatatttacccataactgtgatacagtaaatgtggcagttttgataatgatgtttggcttttttgttttgtttaatgcctgcaaaattatcctgcctatggctcccagaggcctttcccatgcagcatgttctataattatattactgatctaataaacatctatctcttattgtaataaactctctttgtgaacagcctcattaatgtgctgaagtaatgtacccgggggtatttccaacaatttcattgtagctgtaaaatt

SEQ ID NO: 73732 - DNA, 293 bp, Homo sapiens
gtcattggtttacttttgcccgtgggaaaagttgaaaattccttagcatggaatcaaaactctcacatcagtgtggttcttgtcaagttattcagccttatctttcgccacttaccatactctgcacctttgttctagcatccagccaaactagactacatggagctccacagtgatcgtcttcacctccagctgtttgcatttacttcttccctctatcctacatgtgttttccttccccttcagatatcaacctatgaattgcctctaccaaaaagcctacaatattgaca

SEQ ID NO: 73733 - DNA, 361 bp, Homo sapiens
tgctaaaaatcctaaattaaattcagagcaatattgtacttaggtaaaaactttatttttttcactcccttttgcaccaacaggtggccccagtactttgctataatcaatgggtagaagtgacaatctgctgaagttttctggaaaagcttttgatttactgatgaaagaaggcaaacatctctgtatttgatagattcattagaaaaagtggctgtcatacccttcacttccccccacccttttttttttcttgttagagacagggtctctttctgttgctcagactggcacatacccctgcgcttctttccatcttgaatggaatctgatactgagggttgaggacaccattttatac

SEQ ID NO: 73734 - DNA, 418 bp, Homo sapiens
tacaaaacatcccacgcccctccacaattgtcctcacccacttgaaagtatgactgcaatatgtacacacattcacgttggatataatggcaatgctgctcatactccacacttgtattctaagtagctgactgcatgtatgcctccccctgttcacaagttctataaagtcagagacgcttggtttatctgcagagaggcagtgcgaatctggtaccagtagttagaaatgtccactctggagccaaactcctggggcttgaaccttgggtcccccatgtaccaactgtgtgaccttgggccacttaccctctcagtggctcatttcccatctgcgaaatggggcttcgtcgtagtatcaccctggaacatagaaaagctatggtagctgctattaatattagctgttgttgttttc

SEQ ID NO: 73735 - DNA, 287 bp, Homo sapiens
ttaccaatctggaagtgggagcggccgcggttttttcaggtttttgcatttctaacaaccggatggccccatctggacttgccaaccagttctgtggccaccacccaggaactaactcagcagaagagaaccacttctattccctatgagttcatccctgagctaaccaatcaccactcctaattcaccagccccctactcaccaaattatcctaaaaagctctgattcccaggttttcagagagactgatttaagtaatagtaaaactccagtctcccacacagct

SEQ ID NO: 73736 - DNA, 5117 bp, Homo sapiens
ttaatttaatttaatatcattttgctgtagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggagacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggtgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataagtaaataaataaataaataaaatatcttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaaatgcttc

SEQ ID NO: 73737 - DNA, 7272 bp, Homo sapiens
ctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgatgatgggatttagtgaagaaccaggaataattccaagattttgtgaagatcttttttctcaagtagccagaaaacaaacccaagaggtcagctatcacattgaaatgagcttctttgaagtatataatgaaaaaattcacgaccttctggtttgtaaagatgaaaatgggcagagaaagcaaccactgagagtgagggaacatcctgtttatggaccatatgttgaagcactgtcaatgaacattgtcagttcttacgctgatatccagagttggctagaattgggaaataaacaaagagctactgctgctactggtatgaatgataaaagttcccgatctcattcagttttcaccctggtgatgacccagaccaagacagaatttgtggaaggggaagaacacgatcacagaataacaagtcgaattaacctaatagatctggcaggcagtgagcgctgctctacggctcacactaatggagatcgactaaaggaaggtgtgagtattaataagtccttgctaactttgggaaaagttatatctgcactttcggaacaagcaaaccaaaggagtgtttttattccttatcgtgaatctgttcttacatggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaagagtgtggaaagaaaagtttgaacaagctgaaaaaagaaaacttcaagaaacaaaagagttacagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattgtactatcaaaaattttggtgggacagtgagtattatcccagttggggaagcaaagacatatgtaaatggaaaacatattttggaaatcacagtattacgtcatggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacaacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactgagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggagacattggctacaaaacaggctttagaagaccatagcatccgccatgcaagaattctggaagctttagaaactgaaaagcaaaaaattgctaaagaagtacaaattctacagcagaatcggaataatagggataaaacttttacagtgcagacaacttggagctctatgaaactctcaatgatgattcaggaagccaatgctatcagcagcaaattgaaaacatactatgtttttggcagacatgatatatcagataaaagtagttctgacacttctattcgggttcgtaacctgaaactaggaatctcaacattctggagtctggaaaagtttgaatctaaacttgcagcaatgaaagaactttatgagagtaatggtagtaacaggggtgaagatgccttttgtgatcctgaagatgaatgggaacccgacattacagatgcaccagtttcttcactttctagaaggaggagtaggagtttgatgaagaacagaagaatttctggttgtttacatgacatacaagtccatccaattaagaatttgcattcttcacattcatcaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataacttgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggaggaattcatggatgctgtttgtgatggtgtaggcttaggaatgaagattttattagattctggactggaaaaagcaaaagaacttcagcatgaactctttaggcagtgtacaaaaaatgaggttaccaaagaaatgaaaactaatgccatgggattgattagatctcttgaaaacatctttgctgaatcgaaaattaaaagtttcagaaggcaagtacaagaagaaaactttgaataccaagatttcaagaggatggttaatcgtgctccagaattcttaaagttaaaacattgcttagagaaagctattgaaattattatttctgcactgaaaggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggtgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataagtaaataaataaataaataaaatatcttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaaatgcttc

SEQ ID NO: 73738 - DNA, 359 bp, Homo sapiens
ggaggcagctgagccttccctggcaaaagcagatcaatagtctgtgtttctgctgagtgaacttgacaaatgggactgagaagacactgcatgatagatccaaacccaacctgaatccaaacctaatccgccaccatgcacaggaaacagaaaagccaggcacgggatcagaaatactgtcgacagtctaaggacttgggtaggaataaccgcccaaaatcttccgtttccattctcagaaggagctgcccttcttctagggccagtctgggatagattcagatgaggggaaattctcttagaattatcctgtcagtattggctgggcaccgtggctcacgcctataatcctagcactt

SEQ ID NO: 73739 - DNA, 1742 bp, Homo sapiens
  misc_feature (237)..(237): n is a, c, g, or t
atgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaanaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttcc

SEQ ID NO: 73740 - DNA, 867 bp, Homo sapiens
  misc_feature (656)..(657): n is a, c, g, or t
  misc_feature (678)..(678): n is a, c, g, or t
  misc_feature (719)..(719): n is a, c, g, or t
  misc_feature (721)..(721): n is a, c, g, or t
  misc_feature (729)..(729): n is a, c, g, or t
  misc_feature (736)..(736): n is a, c, g, or t
  misc_feature (756)..(757): n is a, c, g, or t
  misc_feature (765)..(765): n is a, c, g, or t
  misc_feature (775)..(776): n is a, c, g, or t
  misc_feature (786)..(787): n is a, c, g, or t
  misc_feature (790)..(790): n is a, c, g, or t
  misc_feature (799)..(799): n is a, c, g, or t
  misc_feature (805)..(805): n is a, c, g, or t
  misc_feature (812)..(812): n is a, c, g, or t
  misc_feature (816)..(816): n is a, c, g, or t
  misc_feature (825)..(825): n is a, c, g, or t
  misc_feature (840)..(840): n is a, c, g, or t
agcgtgggtgcaatcctggctcactgcaacctctgcctcccaggttcaagtgattctcctgcctcagcttcccaagtagctgggactacaggcgtgtgccaccacgaccagaggccaggtgcagtgcatgtaatcccagcactttgggagactgagatgggaagatcgcttgaggccaggagtgcaagaccagcctgggcaacacagcaagaccttgattctactaaaaaaaaaaaaggatccttcaacttcaacaataataacacaagggaagtgaagaaaaacactttctaaggaaatctctctctgagctaccatcctgctagggagagcctgaaagcagaatgctgacttgactagctctggtcaatgaaagaaatcaccagtggaaaggctaccagggggctttctcaaaagagagggacagtaaactgcaagatgaacaactcaatgccatccaggtctggatgagaaagaacagtcgagagactgagtttcaggagtggaaacactcaaagcatcatcttccactttcttctccggctgctaggaagaagggaaaaacacagaccttctgaggacctgcggagcaaaccactggcttcagaaaagcaaacagggacttccctctgcgcagcaggaagcagttagcctanntcggaggcttgactgaagaanccaatgagcggaaggccagaagtttgagacgcagccagtananggaaactnccgggangaggcaggcagccgtccttnnaagaaaangccctatgtnnatgcgaccannccnccggaactnagcggnaacaaantggntccccaccngttctgcaaatcccnactacatgcagcactctccctttcctc

SEQ ID NO: 73741 - DNA, 961 bp, Homo sapiens
  misc_feature (750)..(751): n is a, c, g, or t
  misc_feature (772)..(772): n is a, c, g, or t
  misc_feature (813)..(813): n is a, c, g, or t
  misc_feature (815)..(815): n is a, c, g, or t
  misc_feature (823)..(823): n is a, c, g, or t
  misc_feature (830)..(830): n is a, c, g, or t
  misc_feature (850)..(851): n is a, c, g, or t
  misc_feature (859)..(859): n is a, c, g, or t
  misc_feature (869)..(870): n is a, c, g, or t
  misc_feature (880)..(881): n is a, c, g, or t
  misc_feature (884)..(884): n is a, c, g, or t
  misc_feature (893)..(893): n is a, c, g, or t
  misc_feature (899)..(899): n is a, c, g, or t
  misc_feature (906)..(906): n is a, c, g, or t
  misc_feature (910)..(910): n is a, c, g, or t
  misc_feature (919)..(919): n is a, c, g, or t
  misc_feature (934)..(934): n is a, c, g, or t
agcggaaggggtctgcagtgaaggtcccaaagtcccagacaacttgaagaagctgagtgagaaggccatgcagatatcttggagaagtgcattccaggcagaggaaaagccagtgcagagacactgaagcagggcatgactgatgtgtataaggagcatcatatacatgatcatctacagtccactgaggagaatagcagacgagaggccaggtgcagtgcatgtaatcccagcactttgggagactgagatgggaagatcgcttgaggccaggagtgcaagaccagcctgggcaacacagcaagaccttgattctactaaaaaaaaaaaaggatccttcaacttcaacaataataacacaagggaagtgaagaaaaacactttctaaggaaatctctctctgagctaccatcctgctagggagagcctgaaagcagaatgctgacttgactagctctggtcaatgaaagaaatcaccagtggaaaggctaccagggggctttctcaaaagagagggacagtaaactgcaagatgaacaactcaatgccatccaggtctggatgagaaagaacagtcgagagactgagtttcaggagtggaaacactcaaagcatcatcttccactttcttctccggctgctaggaagaagggaaaaacacagaccttctgaggacctgcggagcaaaccactggcttcagaaaagcaaacagggacttccctctgcgcagcaggaagcagttagcctanntcggaggcttgactgaagaanccaatgagcggaaggccagaagtttgagacgcagccagtananggaaactnccgggangaggcaggcagccgtccttnnaagaaaangccctatgtnnatgcgaccannccnccggaactnagcggnaacaaantggntccccaccngttctgcaaatcccnactacatgcagcactctccctttcctc

SEQ ID NO: 73742 - DNA, 1219 bp, Homo sapiens
  misc_feature (1008)..(1009): n is a, c, g, or t
  misc_feature (1030)..(1030): n is a, c, g, or t
  misc_feature (1071)..(1071): n is a, c, g, or t
  misc_feature (1073)..(1073): n is a, c, g, or t
  misc_feature (1081)..(1081): n is a, c, g, or t
  misc_feature (1088)..(1088): n is a, c, g, or t
  misc_feature (1108)..(1109): n is a, c, g, or t
  misc_feature (1117)..(1117): n is a, c, g, or t
  misc_feature (1127)..(1128): n is a, c, g, or t
  misc_feature (1138)..(1139): n is a, c, g, or t
  misc_feature (1142)..(1142): n is a, c, g, or t
  misc_feature (1151)..(1151): n is a, c, g, or t
  misc_feature (1157)..(1157): n is a, c, g, or t
  misc_feature (1164)..(1164): n is a, c, g, or t
  misc_feature (1168)..(1168): n is a, c, g, or t
  misc_feature (1177)..(1177): n is a, c, g, or t
  misc_feature (1192)..(1192): n is a, c, g, or t
agcggaaggggtctgcagtgaaggtcccaaagtcccagacaagtcccctcttgttgcccaggctggagtgcagcagcatgattacagctcacatcagcctcgacctcccgggctcaagctatcctcctacctcagcctcccaagtagctgggactataggatctttctgctgatgcagctgttaagagtgtttcataaactgtgacaacactaagcaaaatcatagaaggaaactctatggacaatttcagatggagaagaagaaaggactggaagttcaatttggccatgacaattagacttgaagaagctgagtgagaaggccatgcagatatcttggagaagtgcattccaggcagaggaaaagccagtgcagagacactgaagcagggcatgactgatgtgtataaggagcatcatatacatgatcatctacagtccactgaggagaatagcagacgagaggccaggtgcagtgcatgtaatcccagcactttgggagactgagatgggaagatcgcttgaggccaggagtgcaagaccagcctgggcaacacagcaagaccttgattctactaaaaaaaaaaaaggatccttcaacttcaacaataataacacaagggaagtgaagaaaaacactttctaaggaaatctctctctgagctaccatcctgctagggagagcctgaaagcagaatgctgacttgactagctctggtcaatgaaagaaatcaccagtggaaaggctaccagggggctttctcaaaagagagggacagtaaactgcaagatgaacaactcaatgccatccaggtctggatgagaaagaacagtcgagagactgagtttcaggagtggaaacactcaaagcatcatcttccactttcttctccggctgctaggaagaagggaaaaacacagaccttctgaggacctgcggagcaaaccactggcttcagaaaagcaaacagggacttccctctgcgcagcaggaagcagttagcctanntcggaggcttgactgaagaanccaatgagcggaaggccagaagtttgagacgcagccagtananggaaactnccgggangaggcaggcagccgtccttnnaagaaaangccctatgtnnatgcgaccannccnccggaactnagcggnaacaaantggntccccaccngttctgcaaatcccnactacatgcagcactctccctttcctc

SEQ ID NO: 73743 - DNA, 569 bp, Homo sapiens
accagctctcgcgacactttccttggccatggcgagagcacacgagaagagactctcgcaagaaagtaaatgagtcaggctggaaacagcgaagtatatctcgcgatagcactgtttaaaatggcggcttcaaggcgtttcacgggtgtcccggacaggcgtggaggtggggcgcaggcgaggatgaagcttgagttggccaggagtcggaaaacgattgcaggcgggaccgcgtccgtcggggctgaggaaacttagcgtggcagaccctaaactgggataactttagggatatggccttcttttcccagttgcctcaaacttagagcagcgtcgtctttagccgaagattcattttcccagcattttccttctccaggcggagtagttggagacagagggcaagccagaaactgaccttcccatctcctcattcccttccatcaagaacttttcatcgttctttccccaccctggtttgtaaatggtatttggcttcataaaaacgtttgtccacaggtgccctgctccatcagttcgctccagcaatataggaagttaccaaaaaa

SEQ ID NO: 73744 - DNA, 305 bp, Homo sapiens
ataaaatacttaggaatatacctaaccaagaaggtgaaaaacctctccaaggaaaactatgaaacactgctgaaagaaatcatagactacacaaatacatttcatgctcaaggatgggtagaatcaatattgtgaaaatgaccatactgccaaaagggatctacaaattcaacgctatccccatcaaataccaccatcattctttacagaattagaaaaagcaattctaaaattcatatggaaccaaagaaggggcccgcatagccaaagcaagactaagcaaaaagaacaaatctggaagcatc

SEQ ID NO: 73745 - DNA, 481 bp, Homo sapiens
tgctgtctcgcaaatgctggggtccaggactgggcacatcgagggacttggtaggtgcttggttcactgatgtaaaatataggagcacccagggccttgccctttcccacctgcatccctgaatgacaggagagtgtgggagagtgtagggacagcaggcgcagaccccggggcccctgcctgggattggcgtcggggaagacagtcattctggagcgacccctaggcctgatgccttagagcgcaactgccacagacacagcttccttggggggctggccaggccacggaggggcccctggctcccatttctggtccctggatcctgagagcaaggactagggattgtcaccaaggcctccatgagccctcagcagaaggagggccaccctcgagggctccgttatcactggagcccgcgttcaacaaacacgcagatgattctccaaggacagagatggatgatggggagggggctggc

SEQ ID NO: 73746 - DNA, 1259 bp, Homo sapiens
ggagcgagcaagttaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcgggtaaagctgtggctttctttctcttctttgtgaatggacagtggcgtcatgatgcatacaggcagacctgtgtgctgatacctggaaggggtgctcttctgcctggcaggcactgtgactataggcaaaagataagagatagcgaaacgcacccaggaaaagaacaagagtaacaaagccataatgactgacgctcctgagtttaaagcagttgctgttgccctaagattgagaaaagattctgtcaccatgtagtacatgacatctagcaaatctttttctgacaagctgtgaactaggagagtcagaggaccaatcagataacaattgataactctagccagtcgtctccatttctgcctcttttctgccacttcagacttttagattattttatatcacataaggagactaacactgttattaaaaaaaaagaaaagaaaaggaaagaaaagcatctggttttgaaaacctacaaattatttaaagtagactcataggaaatcacaagtatttacatagatcaatacgtgcaagaacacaaatgtgtatatgtatacttgaagttgctcagacaatcagtccttttggaaattattattattattttttgctttcattgatctatactctgttaaactggctgttagtgctaatgcttacagtttcttaagttttgctttaactggaatatgtttgggaaaatctgaactt

SEQ ID NO: 73747 - DNA, 454 bp, Homo sapiens
tctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacaggtaaggaatatatccaaaatggcaaatatgctttcattatcaatataaggcaattgtatatgtagggttactgtcatatttgttacattgaggaacactctaaggcatttaaatatcagtgatttatttgttttataagcaatgatgccctgtgatgcccttgcttttctttatagattttgtaagtttagtgtgaaggataccataatactgtatctcagctgaacaggagtaaactctggaaatgctctgtgactgaaaactgag

SEQ ID NO: 73748 - DNA, 5762 bp, Homo sapiens
ggagcgagcaagttaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttctttttttttttttttttaaagcagatggttgaaacacccatgctatctgttcctatctgcaggaactgatgtgtgcatatttagcatccctggaaatcataataaagtttccattagaacaaaagaataacattttctataacatatgatagtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctc

SEQ ID NO: 73749 - DNA, 2459 bp, Homo sapiens
ggagcgagcaagttaaggctcacgcggggaaatagctgcacagtccggcccagagcgccaagcgcacacaccgagcacactcccacacgcgcacacacgcgctcacactcgccccctcctcgggccccggccctggacccgcgggcgcggactcggtcgcccgccctgggagtcgccacaccgcgcgcgccgcgcccgcccccctcgcacccccacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgcataggctcaagtattgaagactgcatcggcctgatggataggtgtaacggtcccactagtcatgactgcatttactacccatggacgggccattccactttaccacaacatgctaggtaacatctaccatgtttccattttgtcgctcaaatcctttcctagttatcatgaacaaaaagtactaaccagttgggttaaatttataatatattgtaactcataatatatcaaattggaaagttttgaaagaggcataaaacactttccttctca

SEQ ID NO: 73750 - DNA, 262 bp, Homo sapiens
agaaaacgaaatactagattctgacatttcagtgagatttagttgtcaaatttctggaaggatatttaaaagttcatgcttctttattctttataagaagtttgttttagatcaagtcataagcatatgtttccaggctgccgcaatataataagcccaattcttcgttaggtgagaaattagactgggcaactggagagggtagatggtgtccccgtctttcaggaccgttctatcttcatgaagcccttcatgatttctt

SEQ ID NO: 73751 - DNA, 731 bp, Homo sapiens
ccattaaaggtaactttctggggagtcctatagcactaggccaagccttgggggcatgaacaaagggcctgtcacttggccttgcactgccattacatgagatccagtgtttccaaataggccttggttggaagattgagctttctatacctgccattaggtagattagatagatggcttgatagctctctgggctatacttttaataatatataataatctttgggaaggagatagctattttaaatgcaagcaaagcccagaaactatcaaagtccaaatctttcacatatttaaggagtaattgccacatttgaggttaagggaccacttactatggtgcatttgagaaatatatatgaaacggtgagtcagagccctctgaccatcttcagtctacacataagcagataaaccaccaatataaatcttataggggccagacgaggtggcttatgcctgtaatcccagcactttggggggccaaggcaggaggatagtgtgagcccagaagttcaagaccaggctaggcaacatgttgagaccatgttgtttagtctctactaaaaaatataaaaattagccagcatggtggcacacacctgtagtcccagctacttgggagactgaggcaggaggatcacttgagcccaggaggtggaggctgcagggggctgagatctcaccactccattccagcctgggcaacagagcaagactctgtctcaaaa

SEQ ID NO: 73752 - DNA, 272 bp, Homo sapiens
taaacagcaaagttcaagtaacaataaatacatttagatttagaaagttaagtgtagtgtagtttaacatacattgcttaagaaaacaattgtagatgacattaaactaaaccaagaaacactataaaaaagattttgattttagtataaataaaattccttaataagaaaaataaaccatttcatgatcaagctctgatttacaaagagaggattttagggctaaataaatcaaagagaagtaagccttcccccacatcttctctatttca

SEQ ID NO: 73753 - DNA, 331 bp, Homo sapiens
caggtactgccttatgggattgtcataaatctgctctaattgtagaagggaattgtggaagtttttactacattgattgggaaaacttgaaagagaacaaatgagattaaatccagggtttaaaggtctctctccccacccttctcaaaagagaagatggcttatgctgtatcactaaagtcgtgttacttattttaagtcaagcatatttcctttgaggttgaaactgcttttggtaaagtaggtgcttttgataaagtagatggtaaagcacatgctttcatttttttcctattgagagtattttatttctatctgtactacttgacca

SEQ ID NO: 73754 - DNA, 487 bp, Homo sapiens
ccccagggtttatgtcctttactgacttccacattcctttgatgtcccatgtatgtgactggtccctctggacttgcttctggggacatcatgaacctgactctgtaggatgtggggcattgcccaaatagagagtcacatagtttggaaagaaagagactagctgtgggtacatcagtgtgttagtgatgccaggctgggctcatactctctctctttttttttaatatgataaaatatatagaacataaaatataccattttaaaccattttaaagcatagtttgacattaattacattcacactcttgtgcagccatcaccactattcgtttctaaaacatgtttattccaacagaaactctgtacccattgaaatctcttggtctctttgagggtttctctttttacagtccatgaagttaaagtaggacaggcagtctggaacagcaggaactaaagtgcatgtgctgacagcagttccaat

SEQ ID NO: 73755 - DNA, 590 bp, Homo sapiens
gtaaaactgcccagggaagcttgtgacttaaggaattattttattttctgatcctgataatgcaaagtatgtcaagctagaggctgcagatcctttagttctttggacaaaatataatggacaataaagatgtgccacttatagaggaagcaaaatcatggtacataagcttttgatatttgatattttattattctgggaccagagtcagaaatttaattatcataataagaaaggtgttctttggtcttacctttctgtaccacatcttattacataactttctttttttttagtttccatatgcaacactgatttttttggtgtcacccaggctggaatgcagttgtgagatcttggcacactgcagcctccacctccagggttcaagtgatcctcatgcctcaacctcctgagtagctgggattataggcatatgccaccatgctggctaagttttgtatttttagtagagacggggtttcgccatgttggtcaggctggtctcaaactcctggcatcaagttatccatctgccttggcctcccaaagtgctgggattacaggcatgagccaccgcacccagcctg

SEQ ID NO: 73756 - DNA, 570 bp, Homo sapiens
gcatcattcatgaacagtctgaatagagaccatatgaaagtcagttttaaactaagtacaggcacgcctcagagatattgtgggtctggttccaggccaccacacaataaagtgaatattataataaagtgagtcacatgaattttttggtttcccagtgcatataaaagttaggtttacattataatgatcatctaatggaagtctattaactgagcaatagcattatgttttaaaatatatatacgtatcttaattttaaaatactttattgctaaaaaaatgctgacaatcatctgagcctttacaacttgtaatctttttgctggtggaggatcttgcctcaacattgatggtggctgacttagggtggtgttgctgaaggctggggtggctgtggcagttttttcaaataagacagcagtgaagtttgccacatcagttgactcttcctttcacaagagatttctctgtagcatgcaatcctgtttgatagcatttacccacagtagaacttctttcaaaattggagtcaatcctatcaaactctaccactgcttactctactaa

SEQ ID NO: 73757 - DNA, 641 bp, Homo sapiens
tgttccctccagcacttagttacattcctggtgaggtagaattaatggtgcccaccaaatatttctagctatttgaatcttctgggcctacagtagatttacacttcttggtcccctgtggttggttggggacatgtgaccagttattgctaatgagttataacaaagcgatgtgtgaaacctgtgggccaaaattttaattgtcaatgcaagacccttcagtgtcatctgttctcttggctattgtgactatttgtgtttaggaaaatagctactccctcagctgcatcctaaagtgaagaaaaggtcaacttagagcaaagatttagctgacctatgatggactctgtgagagaacaaggaatacatttttgtcatttaaaaccatggagatatgaggttgtttgctacaaagcaaatcctagcccatcctgattcatacacttgtaaatgacaggtgtttgataaatactgtgaatctaaaatattttgcaaatctattagaagtagcaattaataattttatcatcaattgtaaatgtattacgtaaaattgcaaatgttaaaatcagctgtgcagagagacattgtgatgtaaggtgaagagtgtaggacatagagccagtagggatgggtttgta

SEQ ID NO: 73758 - DNA, 386 bp, Homo sapiens
ttttttaaagcttaattaactttccttctgtatatataacctataataatgacaaacatattgggaaaaaattacccctgctttttccccctttctctctacccccattataaagacatttttagctgtggatgcctcactttgttaggatcagatgccattaatttggcatttttgagaagagtaggtggcaggaaatcaaagctttttgagacattggtcatttctaaaccaaatactcacatatctgctggggaaataggctatttttcttttttcctttttttaaagtaaagtttcctgcttgagcccaggagtttgaggctgcagtgagctatgactgcaccactgcattccagcctgggtgacagaacgagatgctgtct

SEQ ID NO: 73759 - DNA, 747 bp, Homo sapiens
  misc_feature (586)..(586): n is a, c, g, or t
tggcagctgcttctctgttggcccaaagggactatcctccaccagtcacccaaagaggactgtctttaaggatatgagatagcaccctaagaggataaatggacattttcttgtctacaaaaagcctaatgcaacagtagaggacatagggaaatttctttggatggatagagacaagtgcatctctttcttacgaaagaatagaaatgtgattaaaaaggaaaagcctagaaacatctgaacgtgtggaaatgggggtgagtgggctagagaaaggatttctgcatcactttcttcctgtagcaattccatccgagatccctgggacagacctggcctgatgaatagcaggaagcacaccagggagggacaaggtcctgcagacaaccttcaccaccaggctgggacagcgccatggggacccagggcctctgctttggggaaagaccttgctgagggccccatgggcaagaacaagtgtgaagaaccctactatggttttttgcccaatgccctccacaaagccagcgtttgaaggaaaactgtgaggaagaagggacactccatggtgttgttgttgccaccnctggagcagcctgtagcaagaacagtcttggtccaaccaggtcagtgatactttttatgatggggctgtgtgggacctgacctgactcttgctaaccagatttctaaagccatctgcagggtcttttctcctattattccccagggcagggagggcaaaca

SEQ ID NO: 73760 - DNA, 673 bp, Homo sapiens
caaatacatttgcagggttgactgtctttctgtaattgatttttagtgctgtttcactgtggtcagagactgtgctctgcgtgggattggctattttggtgtttcttgaggccacttttgttgcttagcaactgatcagaatgtgctgattgttgggtgttctgtgactgtttattaggtcaagtatgtaaactgggttgcttaaattttctgtgtccttgctaatctttattttccctgcttaatctatcaattactgaacgaaggtatgtgaacttttccattattatatggattttaaaatttctctttataaatctatcagtttttgatttttctgttttaagactatattgttagaaacatacagattctggattttaaaaatatctttatggtgaattttcattgtcatatatgatagaaattgttcccatgatcacatgataacctctttcaccctaataatgctttttgtcttgtttattttgtctaatgtaagtatagctagaactgttctcttttgattaatatttgcctagtatgttttttcatttatcattttacaaataattttcatcagtatacagataattttcatcagtatacaaacatagtcaatgtataactgagattactaataaatttggatttatttctgtcattacatgtg

SEQ ID NO: 73761 - DNA, 784 bp, Homo sapiens
catcccctgagccaacttggaaagccccctactgagcaacagctccttgggacgccagtgggaagtacactccccctgtcctggactccggagcttcaccctgtcctctcctccaggccctgtcttgcttaccagcctgtgcccagcctatattcagacctcatttccctcttagactttaagcccgtggtagacagcatcttctactctagaaaaatgtgcgcattcctagtcccctcctagagacgttctagttcaggaggtctgggtgggagacttggcagctgtattattttaaagttccccaggggactcggatccctggctgggtttggaagctgctctgtggcacccagtgtggtacccaccattgagccaacatcattgagctctggaggattaacttgaatctgaagttcccattcacagacccaggttccatggctgagaccatgtttcccaaagtgccttgagcaataactggccaggtgctctcaataaaatataaatcggggccaggcgcggtggctcacgcctgtaatcccagcactttgggaggccaatgtgggcagatcacctaaggtcgggagttcaagaccagcccgaccaatatggtgaaaccctgtctctactgaaaacacaaaattagcctggcatggaggcatgtgcctgtagtcccagctactcaggaggctgaggcaggagaatcgcttgaatccaggaggcggagtttgcagtgagccgagatcgcgccattgcactccagcctgggcaacaggagcga

SEQ ID NO: 73762 - DNA, 779 bp, Homo sapiens
tgggtggggattatgttttttatctttttatcttatcactgatgcgttgtagataaccaagcgcttccccccaaaaacttcagccagggaaagataaaccactcagggtttccattgatcaaatggagaaggcaaagcctaatctgaaacaaaatgtattgctgctctgttatccaccatacctctttctttggtaggaaacatagtatcttaaaggctcaaactggagttagccggtctcagaatggctttagttggtcttaattggaaggagtcgagtccacctccgagtatcttgctagcagtcagcccagtggaattgctgaagataaggaactttgcctacggatgaaagataagaaggtagctgctgagttttaaggattgtttggctgttctggggtgctatatgcctagcttcgctagtctggaggacagcgagggaaaatttttagctaagaataacgagaatcattggccacttagtaacatttccactaaattattgaattgtttaaaggaatttagactttgtttctaaaagttgcctttttgagccagttgttgtgatctttgtactaaattgcacttttgctttaggaggtgggggtaacaatattttcttgtttcacaattcaggttattgaatgacttcagatttacagatttaagagattgaattttgttttgtttttattttttatttttttgagagagtctgaagtcagtcgacaggctggagtgcagtggtgcgatctcggctcactgcaacctctgcc

SEQ ID NO: 73763 - DNA, 835 bp, Homo sapiens
attttctgtagagtcagggcttcactatggtctccaggctgctcttaaactcttggcttggagcagttctccttcctgggccttccaaagtgctgagattacaggtgtgagctactgtgcccagcctacattcagagtcttaaaacacgaaaataaatttgtcagaatagtagaggaaaacatttcagatgtaaaaatcaggatatacactaataaaggtataatggtaacaaaattttgcaaattattagtaaataacaactcacttagcatgttgttgaaaagatactattatgaagtagagaataaagtattactttatatgtttttactatatttttaaattttactttgtttccagcagttttgcttatttattttgcgtggaataatttgtgggtgaccctgagacttttgcatggcttgaacctgctgatatctagtgtctccttaagtggtttgttgaggttttagataattagaagtatttctttaaaatgtaaatattccagtaaacattaagcttcatttaaactctccatttataaaataaaagtatatgttattttgtatccatttttataaagattatagtctttatctaagtgttctaagtcattcattttaactaaacatatggatttgtctgcagaacacgacttaaaagtggcttcagaggaaaagcaagaaacgcttgaaagaagtgaaaataaacagccagagattttcaaagttatagaaaaaagaaggatgtgatatatacaaattgcatattgaagggagatattgccacactcaaacaggaataatacacaataaaaaatgacagtgtcaa

SEQ ID NO: 73764 - DNA, 588 bp, Homo sapiens
gggattacaggtgcacgccaccagtcctggccaatttttttgttgctgtattttagtagagatgaggtttcaccatgttgcccaggctggtcttgaactcctgagctcaggagatctgcccacctcagcctcccaaagtgctgggattacaggcgtgagctactgtgcccggctaactgaccaatttcaagaggggatcagtagtagttccattgcgaccagcttgcccaataaagtttaggggacagtggctttatgttttcaccatcagacaaatacctacacaatgacaagcaaaacctttgccaggcagtatcttctgaaagagattcctgcagttatccaaggaaatagccacttaggtcaatggacgtttgcagagtggaagatagtcttcaaagagcaaacccttacagaaaagcaatagtgcctgccccaaatgtatgtttattgtcaaaaacctcaatccctctttttagaaaaattggatagggaaaaattcattaaccctagagaagtaacttagtcctatctttcacccgatttttgtttgaaatgatggtatagcctacctgattgggaaaaaaa

SEQ ID NO: 73765 - DNA, 173 bp, Homo sapiens
cataaggtcaaactcttttacacagataagagaatccagataagcagaaagaaaagaggcatctattcataatccaactatctagagaaaaccattttctttttttaaagtaaataaaaatgaacttattaaaaaaaaccatttatcatttcacaacacatcaataaccaagt

SEQ ID NO: 73766 - DNA, 407 bp, Homo sapiens
acatacttttggaactcctggcctcaagcagtcctcctgcctcagtctcccagtgctggtattacaggcgggagccaccgcacctggctagtaacatacttttcatgacatctctatggatcctctttattcatcattcaaaaagcaattataagcaactactttcaattcattttagaactctgttgttagaggttttggaattcattttaatcatatgtacatttttaaatgaaatggtatcttcatctattaattagggagaaatgaggtcatcaaaccaaactgaataatgtgaaattaaaagcttaattggaagcgcactgtatcatagggatatccaccttactgaagtaccctcaatgttaaatgagatacatatataaatcaccaagctcagtgcttga

SEQ ID NO: 73767 - DNA, 448 bp, Homo sapiens
gaactgtaaggtcgaataaacattttggacttaaggcctaataaaggatataaaccacaaaattaatctcttgttaggcttctctgcttacatttgtatacttgcttacaatcttcaagcaagagaactctgccatctagaaagaagacgtgggcccattctgcaggcccagaggatgcagggacagctgcaggttcacatttctcagtggcatctattcacattttctgattccaagtctcaagatgccatttcttccttaccaaggtcctggttgttgcatgggattgctgaggacgtaaactaggtttcccttaaggtccactgttttgtttttgtttttgagatggagtctcgctcttgttgcccaggctggagtgcaatggcacgatctcagctcactgcaacctctgcctcccgggttcaagggattatcctgcctcagcct

SEQ ID NO: 73768 - DNA, 309 bp, Homo sapiens
agagagagagaagaactagtgttttcctacatcccttacatttacagggtttctctacagtgtgagtttgtacatatctagaaagattcaactgttcaggctttctcacattccttacattgatagtgttactttctcctgtgaatttttacatgttcagttaggcttgaggaaacagcaaaggtttttccacattcttcacatccacagggcttctctctagtgtgttttcaaatgtgcaatacgagctgagaaagaagcaaaggctttcccacactggtcacattcaaagggtttctctcccatatg

SEQ ID NO: 73769 - DNA, 280 bp, Homo sapiens
atctttctgcaggtgaattgtaaccaatttaaagacaggaccaggtcttttaattcatgtttggttaatgacaccatattccgcccccccctccttttttttttttgcctctgttttccttttggtaggccttagattttatccaaccccctactcctccccacacacaacactctagctttcctactcctagggtctgccagcaactaaccttgtgaccttggtcaaattgcttaacctctcagaaactgcttttctatccatagaatggagttgacgc

SEQ ID NO: 73770 - DNA, 233 bp, Homo sapiens
ggatccggttgcagtgagccgagatcatgccactgcattccagcctgggtgacagagcaagactctgtgtcaaaaaaaaaaaaaaaacttgtagtcttaatgctatttcagaacacagaaaaggaaagaaaacttccacactcattttatgaagcaagtgtaatggtaaccccaacctgacaaagactgcacaaaagatactacagttgaggggggggggggggggggggggg

SEQ ID NO: 73771 - DNA, 119 bp, Homo sapiens
ttctgcattttttaaattttctataattagcaatgtattaccatacacatattttttttgagacagggtctcacttcgtcacccaagctggagtacagtggcatgatcttggctcactg

SEQ ID NO: 73772 - DNA, 459 bp, Homo sapiens
tgtcgaccatccaggctggagtgcagtggcgtgatctcggctgactgcaacctctgcctcccgagttcaagcgattctcctgcctcagcctcccaagtagctgggattacaggtgcccaccaccatgcctggctaatttgtttttttttttagtagacgggatttcaccatgttggccaggctggtctcgaactcctgacctcaggtgatctgcctgccttggcctcccaaagtgctgggattacaggcgtgagccactgcaccaggccaggtctgtcttattcatggcccagaacaatgcccagcacagtattcagtaaagtactgaattaataaatgtgcacaaatgaatacataagaaaacattttgcgatgtcttcatgacggtctctgggaccaactgataactgatagcccacttcagtgtacgtcgacgcggccgcgaatttagtagtagta

SEQ ID NO: 73773 - DNA, 1214 bp, Homo sapiens
  misc_feature (276)..(276): n is a, c, g, or t
gaattccgtccaccatctgagtaacagaaattccagaaagaaaaaccacagacagccgggcctggtggctcacgcctgtaatcccagtactttgggaggccgaggcgggtggatcacctgaggtcaggagtttgagaccagcctggccaacatggtaaaaccccgcctctactaaaaatacaaaaattagccgggcgtggtggcagtgcctgtagtcccagctactcgggagtctgaggcaggagaatcgcttgaacctgggaggttgtgagccanggtcaagggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagca

SEQ ID NO: 73774 - DNA, 2554 bp, Homo sapiens
  misc_feature (1195)..(1195): n is a, c, g, or t
  misc_feature (2198)..(2198): n is a, c, g, or t
  misc_feature (2225)..(2225): n is a, c, g, or t
gagatggagtttttcgctcttgtcgcccaggttggagtgtaatggtgtgatctcggctcactgcaaactcctcctcccaggttcaagcgattctcctgcctcagccacccgagtagctggattacaggcgcgcaccaccacacctggctaattttttttgaaacggggtagagacggagttttattaccatgttagtcaggctggtcttgaactcctgacctcatgatctgcccaccttggcctcccaaagtgctgggattacaggtgtaagccaccgcggctggcccatttcatatatttttaaaattttttattgttaatttatttttagagagggggtctcgttgtattgcccaggctggtcttgaactgggctcgtgcgacgtgcccgcctcggcctcccgaagggctgtgatgacagcacagcggtgcctgtgatctatggcttcaatttttcaaggctgccaggtccatgcaggggtgtgtgtgggatgcatccctagaaatcaaaggtcatgtgcgtgtgtgactggtggatgctgatggtcacactaccctccagaaaggcagcaacatgttcagtccaccgtggcgtcctgagctgtgagtggcctctggtctcctctcttctaaggctgttgattgtgttaaccagcttttatggagcccctgctaggtggtggaaaatgggcagtagtgtatgttttcatcctctcagcagccctggaggcccggctgtttctgcaaggctcagaggtgagctggttgttctgcctcacacagcaggggccgagcagggggtggaactgaggtccagcctggctgcaggctcagggcgtttcctgctgggttacactggagttgtgtgcgctccaagggctttgtgccaccccaccctcatggtccagggccaggctgtgactgggagggtggcacgtggaagactggaccagggttttctagctgggcccactcagctggccctccctgtgaccccagcgtggcccctgaccctctcggtttgcctgcctgtgaaacaggaagtgtcagatcccgcctgcttggctttgacaggactgggcgaggtcatgagagtctgagggtccctaccaggagttcgacctcatcctcaggtccagccccatccacctctgcccccaaccccgctctgacactcctgcagcctcggccctngaacacctgctgagggctgagcagaacacatctctacttgcttgtgcttctgggcaacctgggaggggcttgggaggtagatggcgtttccccatcttccagatgagccataggcgagctgtcgagtgcagagctgttcaccaaatgtaggctgctctgtccagaacctgccctccctcccactcggagccctgcaggtgccctcaaggccgtgggtgtggtactcttttctgcacatactagatttgcatcctaacctcttagggtaaaatagggcttctgactggcgcctggtgtttccactggtgagtgtgtaggaggctaagtgcgggctgtagcctgggtggggacacatggctaggtgtgtcttccttcaccaaagaagggtttcaactactcatttgcaagtttgctggaaaaaaaaagataataaaaaccagtccagtttcctggatctgcagctgcagtgacctcacagtgggtcctctgggaataggttgccttcatgtcttcagtcaacaaacatatgtctgctctatgccaggccttgggctgacaaccagaaactgataagagcagcagcccctctcttagcggtttactctgtgccggatcatttcatccccacaacagtcctgtgcaataggtgttactagtatctccattctaattttttttttttctgatatggagtcttgccctgtagcccagcctggagtgcagtggtcagctggagccagaggggagcagagacaggggctgcaggacccccaggaggcccccaagcagactctgagggtccaagaaggtgatgcctgaataggccagcctcatacccatcctctcagtactttgggaggcccaggcgggagttgaagccaggagttccgagacaagcctgggcaacaaagcaagaccctatctctacagcaattctataaaaatgagccaagtgcagtggtacatacctgtcgagttaccctggaggctgaggtgggatgantacctgagcccaggagtttgaggctgnagtgagcatgatcaggccactgcactccagcctgggcaaacgggtgagaccctgtctgtgaaaaaaataataataaaatttaatttttaaaaaaggaccaataggcgtaggcatgggccggtctgaggttggctggtgagctctgcacatttgaagactttggaggcatggcaggaccaggcaccatccatggaaagcatacttgagtgtggttagcgcgggaaccaagattggggtggcagggccacagggggagggcctgttagtggatgtggcacaaccccccacttgtttttgagactgtctcaaaaacaaacaaacaaacaaac

SEQ ID NO: 73775 - DNA, 469 bp, Homo sapiens
tgacgcattggccctgcggctggcctgcatcggggacgagatggacgtgagcctcagggccccgcgcctggcccagctctccgaggtggccatgcacaggtagccggcctatgccctatgcctctacacctggggaggggccctgggcggtgggtggaggccctgaacacagcacagggctgggccctgaggaagctctgtgggggatgtgccttgacactggggctatactgaaacccttggctgcttcccgcacctctcctgggagcccccagctcctggcactcgccccctgccacctgtccctggcattcctgggcaacaaagcagagcccagggcccttttctctctcgccgtcctcattgagcccagatggtacatttccaccgtggtcttaagagggggtgctacgtgagctcggatcctagatcctgggggctgggcctctcagcgagtctccggtggggg

SEQ ID NO: 73776 - DNA, 5162 bp, Homo sapiens
  misc_feature (1195)..(1195): n is a, c, g, or t
  misc_feature (2198)..(2198): n is a, c, g, or t
  misc_feature (2225)..(2225): n is a, c, g, or t
  misc_feature (2533)..(2533): n is a, c, g, or t
  misc_feature (2559)..(2559): n is a, c, g, or t
  misc_feature (2595)..(2595): n is a, c, g, or t
  misc_feature (2614)..(2614): n is a, c, g, or t
  misc_feature (2618)..(2618): n is a, c, g, or t
  misc_feature (2643)..(2643): n is a, c, g, or t
  misc_feature (2676)..(2676): n is a, c, g, or t
  misc_feature (2682)..(2682): n is a, c, g, or t
  misc_feature (2685)..(2685): n is a, c, g, or t
  misc_feature (2749)..(2749): n is a, c, g, or t
  misc_feature (2783)..(2783): n is a, c, g, or t
  misc_feature (3999)..(3999): n is a, c, g, or t
  misc_feature (4168)..(4168): n is a, c, g, or t
  misc_feature (4394)..(4394): n is a, c, g, or t
  misc_feature (4404)..(4404): n is a, c, g, or t
  misc_feature (4556)..(4557): n is a, c, g, or t
gagatggagtttttcgctcttgtcgcccaggttggagtgtaatggtgtgatctcggctcactgcaaactcctcctcccaggttcaagcgattctcctgcctcagccacccgagtagctggattacaggcgcgcaccaccacacctggctaattttttttgaaacggggtagagacggagttttattaccatgttagtcaggctggtcttgaactcctgacctcatgatctgcccaccttggcctcccaaagtgctgggattacaggtgtaagccaccgcggctggcccatttcatatatttttaaaattttttattgttaatttatttttagagagggggtctcgttgtattgcccaggctggtcttgaactgggctcgtgcgacgtgcccgcctcggcctcccgaagggctgtgatgacagcacagcggtgcctgtgatctatggcttcaatttttcaaggctgccaggtccatgcaggggtgtgtgtgggatgcatccctagaaatcaaaggtcatgtgcgtgtgtgactggtggatgctgatggtcacactaccctccagaaaggcagcaacatgttcagtccaccgtggcgtcctgagctgtgagtggcctctggtctcctctcttctaaggctgttgattgtgttaaccagcttttatggagcccctgctaggtggtggaaaatgggcagtagtgtatgttttcatcctctcagcagccctggaggcccggctgtttctgcaaggctcagaggtgagctggttgttctgcctcacacagcaggggccgagcagggggtggaactgaggtccagcctggctgcaggctcagggcgtttcctgctgggttacactggagttgtgtgcgctccaagggctttgtgccaccccaccctcatggtccagggccaggctgtgactgggagggtggcacgtggaagactggaccagggttttctagctgggcccactcagctggccctccctgtgaccccagcgtggcccctgaccctctcggtttgcctgcctgtgaaacaggaagtgtcagatcccgcctgcttggctttgacaggactgggcgaggtcatgagagtctgagggtccctaccaggagttcgacctcatcctcaggtccagccccatccacctctgcccccaaccccgctctgacactcctgcagcctcggccctngaacacctgctgagggctgagcagaacacatctctacttgcttgtgcttctgggcaacctgggaggggcttgggaggtagatggcgtttccccatcttccagatgagccataggcgagctgtcgagtgcagagctgttcaccaaatgtaggctgctctgtccagaacctgccctccctcccactcggagccctgcaggtgccctcaaggccgtgggtgtggtactcttttctgcacatactagatttgcatcctaacctcttagggtaaaatagggcttctgactggcgcctggtgtttccactggtgagtgtgtaggaggctaagtgcgggctgtagcctgggtggggacacatggctaggtgtgtcttccttcaccaaagaagggtttcaactactcatttgcaagtttgctggaaaaaaaaagataataaaaaccagtccagtttcctggatctgcagctgcagtgacctcacagtgggtcctctgggaataggttgccttcatgtcttcagtcaacaaacatatgtctgctctatgccaggccttgggctgacaaccagaaactgataagagcagcagcccctctcttagcggtttactctgtgccggatcatttcatccccacaacagtcctgtgcaataggtgttactagtatctccattctaattttttttttttctgatatggagtcttgccctgtagcccagcctggagtgcagtggtcagctggagccagaggggagcagagacaggggctgcaggacccccaggaggcccccaagcagactctgagggtccaagaaggtgatgcctgaataggccagcctcatacccatcctctcagtactttgggaggcccaggcgggagttgaagccaggagttccgagacaagcctgggcaacaaagcaagaccctatctctacagcaattctataaaaatgagccaagtgcagtggtacatacctgtcgagttaccctggaggctgaggtgggatgantacctgagcccaggagtttgaggctgnagtgagcatgatcaggccactgcactccagcctgggcaaacgggtgagaccctgtctgtgaaaaaaataataataaaatttaatttttaaaaaaggaccaataggcgtaggcatgggccggtctgaggttggctggtgagctctgcacatttgaagactttggaggcatggcaggaccaggcaccatccatggaaagcatacttgagtgtggttagcgcgggaaccaagattggggtggcagggccacagggggagggcctgttagtggatgtggcacaaccccccacttgtttttgagacaagtctngctctgtcacccaggttggagtgcantggcgcggtctcggctcactgcatattctgcctccnggattcaagtgattctccngccncagcctcccaagtagctgggattanaggcgagcgccaccacacctggttaatttttgnattttnagnggagatggcgtttcaccatgttagccaggctagtctcaaactcctaagctcaggtgatccaccngcctccacctctcaaagtgctgggattacaggcntgagccgcactgcaccaggccaggtctagggagccgaacagagcagtgacagggtcagggttgaggctgctaccttgagattaggttggagagagctccactgaaggctggagaccagtaaggcattcagagctggtgccaggtaggagctgacaggactgggcctcccttgggctggtggggtggccaggagagaccagagcaggaggtcgctgctgcaaggaccctcctgggcaggctccccaccttccgctccctggctccacacttttcccatgcagatctgggccctaaggccagcctaggcccagttggtgatgggatctttgccattcatatcaagtcaatctgagggcctgggcccagaggccagatggttaaaggttcagattaggtcccttctttgtggtagagggtaatgggtatttaataaattaatccaaagtgctgtaatcccagtactttgggaggccgaggcgggtggatcacctgaggtcaggagtttgagaccagcctggccaacatggtaaaaccccgcctctactaaaaatacaaaaattagccgggcgtggtggcagtgcctgtagtcccagctactcgggagtctgaggcaggagaatcgcttgaacctgggaggccaggaggcagaggttgcagtgagccaagattgtgccactgccctccagcctccagcaagactcagtatccaaaaacaaagaaagaaagaaagggcccttatgaatcatcttcaagttcctcccttccaagaacagagatgctaggcgacttgcccagaggcacacagccagcatgtagcaggattcatgcctgtgggagctggggttgggggatattgacggctttagcggatcaaaagagctggtgagtagggctatacaatctgggggtcatcctgtgagagagcccccagactgctcagttcttaggggtccagtcatatgctgtctttttgccccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcaggtaggtccccatggcctgccctaccccctgcctgatagtgacttcaggggtgggctggatgagcagacnttctatgagcgggggagcgcctgcagatgcctcccaggcagggcctccgagaggaagatttcccggatgtgggcatggaggcttctgccctgggagcggcttcactttgctgccccaccctcccctgataccagctcacagacccctggacagccagcatgttcacagnctcaagatggacctggggcccctggctgtcaaaatggcacagtgtttgggcctcagggagctagacaggcccttagcgacctgctgaggacatcagggcctcttgaaggaggtgactctgttgccagaaaggggacccgatccagatcccaagagagggttcttagatctcaagcaagaaagaatttgggccacacgcagtggctcgcgcctgtaatcccagcacntagggaggcngaggcaggcggatcacttgaggtcaggagctcgagaccagcctggccaacatggcaaaaccctgtctctactaaaaatacaaaaagtagctgggcctggtggcacatgtctgtagtcccagctagtcgggaggctgaggcaggagaatctcnngaacccaggaggcagaggttgcagtgacccaaggttgcaaaaatgcactccagcctgggcaacagagcgagactccatctcaaaaaaagaaaacctactctataggcagagcagcggcatgggctgctcaactgaatatacttatagttatttcctgattacatgctaaacaaggggtggattattcatgagtttccgggtaaggggtgggcagttcccggaaccgagaattcctcctccttttagacaatatagggcaacttcctgacgttgccgtggcatttgtaaactgtcgtggcactggtgagtgactccaacatgctaatatagttggtgcacaatgaatagtgaggatgactggaggtcacttttgtgcccatcttggctttggtgggctttggctggcgtctttgccgaatcctgttttatcagcagggtctttgtaacctgtatcttatgctgatgtcctatctcatcctgtgacttagaattcctagcctcctgggaatgcaacccagtaggtctcagccttttgttacccagcccctaatcaagatggagtcgctctggttcaactgcctctgacggctctcattttagaaaac

SEQ ID NO: 73777 - DNA, 4369 bp, Homo sapiens
  misc_feature (1195)..(1195): n is a, c, g, or t
  misc_feature (2198)..(2198): n is a, c, g, or t
  misc_feature (2225)..(2225): n is a, c, g, or t
  misc_feature (2533)..(2533): n is a, c, g, or t
  misc_feature (2559)..(2559): n is a, c, g, or t
  misc_feature (2595)..(2595): n is a, c, g, or t
  misc_feature (2614)..(2614): n is a, c, g, or t
  misc_feature (2618)..(2618): n is a, c, g, or t
  misc_feature (2643)..(2643): n is a, c, g, or t
  misc_feature (2676)..(2676): n is a, c, g, or t
  misc_feature (2682)..(2682): n is a, c, g, or t
  misc_feature (2685)..(2685): n is a, c, g, or t
  misc_feature (2749)..(2749): n is a, c, g, or t
  misc_feature (2783)..(2783): n is a, c, g, or t
  misc_feature (3431)..(3431): n is a, c, g, or t
gagatggagtttttcgctcttgtcgcccaggttggagtgtaatggtgtgatctcggctcactgcaaactcctcctcccaggttcaagcgattctcctgcctcagccacccgagtagctggattacaggcgcgcaccaccacacctggctaattttttttgaaacggggtagagacggagttttattaccatgttagtcaggctggtcttgaactcctgacctcatgatctgcccaccttggcctcccaaagtgctgggattacaggtgtaagccaccgcggctggcccatttcatatatttttaaaattttttattgttaatttatttttagagagggggtctcgttgtattgcccaggctggtcttgaactgggctcgtgcgacgtgcccgcctcggcctcccgaagggctgtgatgacagcacagcggtgcctgtgatctatggcttcaatttttcaaggctgccaggtccatgcaggggtgtgtgtgggatgcatccctagaaatcaaaggtcatgtgcgtgtgtgactggtggatgctgatggtcacactaccctccagaaaggcagcaacatgttcagtccaccgtggcgtcctgagctgtgagtggcctctggtctcctctcttctaaggctgttgattgtgttaaccagcttttatggagcccctgctaggtggtggaaaatgggcagtagtgtatgttttcatcctctcagcagccctggaggcccggctgtttctgcaaggctcagaggtgagctggttgttctgcctcacacagcaggggccgagcagggggtggaactgaggtccagcctggctgcaggctcagggcgtttcctgctgggttacactggagttgtgtgcgctccaagggctttgtgccaccccaccctcatggtccagggccaggctgtgactgggagggtggcacgtggaagactggaccagggttttctagctgggcccactcagctggccctccctgtgaccccagcgtggcccctgaccctctcggtttgcctgcctgtgaaacaggaagtgtcagatcccgcctgcttggctttgacaggactgggcgaggtcatgagagtctgagggtccctaccaggagttcgacctcatcctcaggtccagccccatccacctctgcccccaaccccgctctgacactcctgcagcctcggccctngaacacctgctgagggctgagcagaacacatctctacttgcttgtgcttctgggcaacctgggaggggcttgggaggtagatggcgtttccccatcttccagatgagccataggcgagctgtcgagtgcagagctgttcaccaaatgtaggctgctctgtccagaacctgccctccctcccactcggagccctgcaggtgccctcaaggccgtgggtgtggtactcttttctgcacatactagatttgcatcctaacctcttagggtaaaatagggcttctgactggcgcctggtgtttccactggtgagtgtgtaggaggctaagtgcgggctgtagcctgggtggggacacatggctaggtgtgtcttccttcaccaaagaagggtttcaactactcatttgcaagtttgctggaaaaaaaaagataataaaaaccagtccagtttcctggatctgcagctgcagtgacctcacagtgggtcctctgggaataggttgccttcatgtcttcagtcaacaaacatatgtctgctctatgccaggccttgggctgacaaccagaaactgataagagcagcagcccctctcttagcggtttactctgtgccggatcatttcatccccacaacagtcctgtgcaataggtgttactagtatctccattctaattttttttttttctgatatggagtcttgccctgtagcccagcctggagtgcagtggtcagctggagccagaggggagcagagacaggggctgcaggacccccaggaggcccccaagcagactctgagggtccaagaaggtgatgcctgaataggccagcctcatacccatcctctcagtactttgggaggcccaggcgggagttgaagccaggagttccgagacaagcctgggcaacaaagcaagaccctatctctacagcaattctataaaaatgagccaagtgcagtggtacatacctgtcgagttaccctggaggctgaggtgggatgantacctgagcccaggagtttgaggctgnagtgagcatgatcaggccactgcactccagcctgggcaaacgggtgagaccctgtctgtgaaaaaaataataataaaatttaatttttaaaaaaggaccaataggcgtaggcatgggccggtctgaggttggctggtgagctctgcacatttgaagactttggaggcatggcaggaccaggcaccatccatggaaagcatacttgagtgtggttagcgcgggaaccaagattggggtggcagggccacagggggagggcctgttagtggatgtggcacaaccccccacttgtttttgagacaagtctngctctgtcacccaggttggagtgcantggcgcggtctcggctcactgcatattctgcctccnggattcaagtgattctccngccncagcctcccaagtagctgggattanaggcgagcgccaccacacctggttaatttttgnattttnagnggagatggcgtttcaccatgttagccaggctagtctcaaactcctaagctcaggtgatccaccngcctccacctctcaaagtgctgggattacaggcntgagccgcactgcaccaggccaggtctagggagccgaacagagcagtgacagggtcagggttgaggctgctaccttgagattaggttggagagagctccactgaaggctggagaccagtaaggcattcagagctggtgccaggtaggagctgacaggactgggcctcccttgggctggtggggtggccaggagagaccagagcaggaggtcgctgctgcaaggaccctcctgggcaggctccccaccttccgctccctggctccacacttttcccatgcagatctgggccctaaggccagcctaggcccagttggtgatgggatctttgccattcatatcaagtcaatctgagggcctgggcccagaggccagatggttaaaggttcagattaggtcccttctttgtggtagagggtaatgggtatttaataaattaatccaaagtgctgtaatcccagtactttgggaggccgaggcgggtggatcacctgaggtcaggagtttgagaccagcctggccaacatggtaaaaccccgcctctactaaaaatacaaaaattagccgggcgtggtggcagtgcctgtagtcccagctactcgggagtctgaggcaggagaatcgcttgaacctgggaggttgtgagccanggtcaagggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagca

SEQ ID NO: 73778 - DNA, 438 bp, Homo sapiens
gaccgcagcccgctggaggtgccgggggcgaaatgctggcgtctgctcctccgtctcccagaatcctgccctggaaaaaaccagcgccaaccgccggtttaactgaggacggatttaaggcattacgaaagacagctttcccctttgctcggctctccttctctctcctgctgccctgtgaagaggtgtcttctgccataattgaaaatcaaatttaacaactgtttccaccagaaaaccatcatcataagaaccaaaaattaggcgaggactcacagtacctgggtttaacttcatgtcgctgaaagaggcactgaaaaggaagaggaagacagagctcttaccagggggaggcagagatggcacagcaagagacatgcccccagaatgccaccaatgccccaggacaggcccacccatgggaccaggttatcggga

SEQ ID NO: 73779 - DNA, 297 bp, Homo sapiens
atgttagcttgtaattaagctgacttttaaccactgagctccttaaaaaaaatctttttaaatcttatgaccgtagttcagctggaacaaattgctgttattttagaagtaccaagtatcaaaccagaaagggcttgatttaggaaacaaacccaggctattgtggtggaaaaaaagatggcagaacccttagctatggaacagcagcgtgagacgacagccattgctcttttggttggcctgactagcaaaaaggtggccttgttatgtaaataaagccttttaagtagtcaaaaa

SEQ ID NO: 73780 - DNA, 409 bp, Homo sapiens
ggaaggcttatcagagtggccacctagacagaggcatggtagcctgagttcagacctagcctggactttcacccagccagacttcagttgtgcctgtaccttgtgggatgacacatgcccgtctccaactcatgcaggctctcagtgagaggtagttggctccagccagcttgcacctccccactgctggtcttatcctaggaccactgcagggagacgatctctcagtttggggtctttgaaggctcagggagctcctagccagctgactaggctggggtccatcctgataacatgagagagagaagatgtctgtatctctggtgtgtctttacttttcaggccaccaagggttaagaacccagcgtcagccagtgagtagtagacatctgttctccttttgagaaag

SEQ ID NO: 73781 - DNA, 442 bp, Homo sapiens
ggaaggcttatcagagtggccacctagacagaggcatggtagcctgagttcagacctagcctggactttcacccagccagacttcagttgtgcctgtaccttgtgggatgacacatgcccgtctccaactcatgcaggctctcagtgagaggtagttggctccagccagcttgcacctccccactgctggtcttatcctaggaccactgcagggagacgatctctcagtttggggtctttgaaggctcagggagctcctagccagctgactaggctggggtccatcctgataacatgagagagagaagatgtctgtatctctggtgtgtctttacttttcaggccaccaaggaagggaaagccgtggtgagtcctgaactacaggctttctcaaaaggagaacggatgtctactactcactggctgacgctgggttcttaac

SEQ ID NO: 73782 - DNA, 80 bp, Homo sapiens
tggatatgatgactgattacctgagaaataattgatgaaatctcaagaaaattcctctagatagtcaagttctgatccag

SEQ ID NO: 73783 - DNA, 505 bp, Homo sapiens
ttgttttcatcttagtcaagatttcttccatgcagttttcttcctaatttttatatagttaactttatgcaactttttagtttctcgagagactgagaaggtcctttctctctccaaacttgtaagaaaaatttctcgtgcagtacttgtgtgatttcatactttacagttgacaccttgatagacctagtctctatttccttatagggagagcataaacaagaagctttattatttttcagcagtaaccttagttgccccagcgccattactgaataatcacatttttatcatcggtagtgtcatcatcataacacatcagcaaggaagtttttccttcacagtggcacggtggctcactcctgtaatcccagcactttgggaggccgaggcaggtggatcatgaggtcaggagatcgagaccatcctggtgaaacctagtgaaaccccgtctctactaaaaatacaaagtaggagaaaatacttgcaatgaaaaccgtcgacc

SEQ ID NO: 73784 - DNA, 220 bp, Homo sapiens
accataggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaattgtccacaggaagtgcttctaaagtcagaacaggtt

SEQ ID NO: 73785 - DNA, 2312 bp, Homo sapiens
cggggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgttta

SEQ ID NO: 73786 - DNA, 1221 bp, Homo sapiens
agctttaaaaacttaaaaccactttctaaactgctttttagaaaacttttaaaacaaaaaaaaaattcaatttttttttaatttattattttttttctgagacggagtctcattctgtcacccaggtggaggttgtagtgagctgagatcgtgccactgcatgccagcctgggcgacagagcaagaccctgtcaaaaataataataataataaaggcaattgttctagtgatgttaagtgagcttaatgtatcactgcagatgctgaacttatatgataggtgaaatagaaagggtgaatttaaaacagaactttttatctcattctttctttctgttctttttaataaaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgttta

SEQ ID NO: 73787 - DNA, 858 bp, Homo sapiens
atgtgataaaatttccagttactaactttcaagaatgcaaagtgtataatttattgctttaaaatttctttctgaaggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgttta

SEQ ID NO: 73788 - DNA, 2222 bp, Homo sapiens
  misc_feature (2215)..(2215): n is a, c, g, or t
cggggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtaataaataaattggtggtattattttagctattgctagatgggtggtaaaatgtggtaccaattgcattacagtacactaatgcattttgacgtgatcttattaatataaggattcttgatcctgttaaaaactacatggagagtcccagactttgaaatcgagacagtgggaccttggcagtatttgggggtaccaagctgaataatattttattagtggcaaacactaaacagtagcaggcactattctaagcagtttacatatattaactaagttaatcctcttaacaaccctgtgaggtaagtactattaattctccttttacagttgaagaaactgacatacggaaagtttaaataactcgcctaaggtcaaggattcagaacagcacccatgtgactccagagtcatgaacccctggaaaatttttcagatttcctgggatatttgccccaggaatctgaaagatggtggaaagattaactgtatctcaggcacccaaagatacacttatcttgagaaaacatttgactttttgggttttggccctctgccttcagcagatataaaggacaatgtggtacttgtgagagctgctcaaagtctgaatccactgtccttcactggtctttatcagctagcaaaagatcaagtgtttaaaggggggaagccccccccanaaaggtg

SEQ ID NO: 73789 - DNA, 1213 bp, Homo sapiens
agctttaaaaacttaaaaccactttctaaactgctttttagaaaacttttaaaacaaaaaaaaaattcaatttttttttaatttattattttttttctgagacggagtctcattctgtcacccaggtggaggttgtagtgagctgagatcgtgccactgcatgccagcctgggcgacagagcaagaccctgtcaaaaataataataataataaaggcaattgttctagtgatgttaagtgagcttaatgtatcactgcagatgctgaacttatatgataggtgaaatagaaagggtgaatttaaaacagaactttttatctcattctttctttctgttctttttaataaaaggaaggattacggccaggagatacaaccagcactttctgtggtactcctaattacattgctcctgaaattttaagaggagaagattatggtaataaataaattggtggtattattttagctattgctagatgggtggtaaaatgtggtaccaattgcattacagtacactaatgcattttgacgtgatcttattaatataaggattcttgatcctgttaaaaactacatggagagtcccagactttgaaatcgagacagtgggaccttggcagtatttgggggtaccaagctgaataatattttattagtggcaaacactaaacagtagcaggcactattctaagcagtttacatatattaactaagttaatcctcttaacaaccctgtgaggtaagtactattaattctccttttacagttgaagaaactgacatacggaaagtttaaataactcgcctaaggtcaaggattcagaacagcacccatgtgactccagagtcatgaacccctggaaaatttttcagatttcctgggatatttgccccaggaatctgaaagatggtggaaagattaactgtatctcaggcacccaaagatacacttatcttgagaaaacatttgactttttgggttttggccctctgccttcagcagatataaaggacaatgtggtacttgtgagagctgctcaaagtctgaatccactgtccttcactggtctttatcagctagcaaaagatcaagtttaagaccaaggaggcaggagaatggcgtgaacccgggaggcggacgcttgcagtgaaccgagattgtgccactgcactccagcctgggcgacagagtgaaactctgtctcaaaa

SEQ ID NO: 73790 - DNA, 2483 bp, Homo sapiens
cggggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaccaactttttatattacctatta

SEQ ID NO: 73791 - DNA, 1449 bp, Homo sapiens
ataggtacaactaggtgttagaaatataatgtactacgcaaagcatttcccattataactctgatacaaatgttctcaacaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgttta

SEQ ID NO: 73792 - DNA, 2304 bp, Homo sapiens
cggggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtaataaataaattggtggtattattttagctattgctagatgggtggtaaaatgtggtaccaattgcattacagtacactaatgcattttgacgtgatcttattaatataaggattcttgatcctgttaaaaactacatggagagtcccagactttgaaatcgagacagtgggaccttggcagtatttgggggtaccaagctgaataatattttattagtggcaaacactaaacagtagcaggcactattctaagcagtttacatatattaactaagttaatcctcttaacaaccctgtgaggtaagtactattaattctccttttacagttgaagaaactgacatacggaaagtttaaataactcgcctaaggtcaaggattcagaacagcacccatgtgactccagagtcatgaacccctggaaaatttttcagatttcctgggatatttgccccaggaatctgaaagatggtggaaagattaactgtatctcaggcacccaaagatacacttatcttgagaaaacatttgactttttgggttttggccctctgccttcagcagatataaaggacaatgtggtacttgtgagagctgctcaaagtctgaatccactgtccttcactggtctttatcagctagcaaaagatcaagtttaagaccaaggaggcaggagaatggcgtgaacccgggaggcggacgcttgcagtgaaccgagattgtgccactgcactccagcctgggcgacagagtgaaactctgtctcaaaa

SEQ ID NO: 73793 - DNA, 372 bp, Homo sapiens
tatcctgcattcttcaaagggtaaacattcacataatttgatcaatgcggggaggcgtacagtgaaaaccaatgctgtcaataatccttgctcatgacaacaagaagaggcccaaaatgaccctccacacgagcgagacgtgagcttttgttgagagatttcagccgaacacatagggtcaaggatgcccactcgggaatatgcccactgcacccacctcctcctagctgtaccctcagttgctgattcagagctggcagctgagggatgggggcacctgtgactttgaaggtggcccttgaggcgggagcttctcctgtgccccgtgggtgccaggacaggaggcccgggcactgggggactccgagggag

SEQ ID NO: 73794 - DNA, 424 bp, Homo sapiens
caaaggagaaattcaacagtgtcaagaaattttttaaaaatactaaagtaattggtacatttaaaaatgtgattttccttaattatacaggttagggaaacagggtaatgtttcaaacactatggttactttacttaacagtagttatattttttaattacttgaaattataagcactatgattacatgggaggcttgctgtaaaggctgccttatcagaagggccttttggctattggtaaccactttccagagtctacggtggaacagcaatatgctgaattacagggaagtgcattttatggtgcgattgtaatgattccacgtgacagtaaatagaagtcctataattttctttatattcactcattcattcattcttagtaaaaataatttaccataaaacttacactgtggagaagca

SEQ ID NO: 73795 - DNA, 601 bp, Homo sapiens
gccagatgtgatgcccataaccctaaattcttgaatgagtatttcctgacaaaaacactttccaacatagtgacagtgcagcatccaaagcaacattcacagcgatgcagtactgccatctaatccggagacccactgaaactgaccagttactgtaactatgtcctttatggcacagaacaaagtcagtctggttcagtatccagcatttagttgtcatctcttgttagtctcctttattctgaaacagttcctcagtctctccttgtctttcatgaccttggcattttgaagaacacaggccagttattttatagaatgtttcctcatgattagattcaggctatacatttttggcaggaataccacagaaatgctggcctaatgatacctttttaaagtttcaagtagccacagcctaggtgtcctaatacattaaaaccacgcaaactcagatgatatggggatgtcaatctaaattacacaagccatttttaaagaaatacagttttgtcatcttcaggggcacgcattaccttgagtttgattaaagttgttgccaagtgtcctttgggaattgacattactaaatagataataa

SEQ ID NO: 73796 - DNA, 1077 bp, Homo sapiens
ctttctcagggggaattgggtttttttacatacaactgagttttcgcttacacgttctttaatttcttttaattcctgtttcatcaccaggctggaatgtagtggtgcaataacagctcactgtagcctcgacctcctgggctcaagccatccccaacctcaccctcccgagtagctgggaccacaggcgtgtgccaccacactcagctaatttatttaaaacaattttttttagagatgaggtctccctttgttgcccagctggtctgaaattcctggtttcaagtgaccctcacacgtcagcctcctaaagaggtgaagttataagcatgaaccattgtggccagcggtgggactgatccttacaaggtcttgtgtgcttcttatctctcttggaaccacgtcatggccatgaaaacaagctcaagctagcctactgaaggatacaagaaccatagaggaaagctgagtcactttagctgaggccataatagactgatcagccccctgccaacaaccagtgatggcagatgcttgatcgggccccagaaagttcatcagaaatgagtgagtcaaggtcacaataactgatcagctgaaccatggactcaggaaaaattttttttaaaggtagttgtttgttttgttttttaacataccagtagctacatagcccatattgcaaatgacatcaaattggacagaatggttactgggttgtaattttggaatgacggattctaagtatcaagaagaatctgaatgggaacaaatgtataattctcatgaagtgctgtacttgattaaaaactcaatacaaaactaagatggtctccagatacaaggatgtaatattttccaatatatttttagcaaactctctggaatagttggttgtacttcggaggctggtctagggaagaatggttagaatcagtctagaaatcatgtcaaattcttatcacttgctatcaaactagctggttcaattccttattagtgatctgcaataagataaaatcttgtgctacaacataaagcaactatctcaataaacacagtttaattcagctaact

SEQ ID NO: 73797 - DNA, 507 bp, Homo sapiens
aaaattaggagccatatgaactaattaattgtatggattaccataaaaatgtattcattcctgcagtgtttctaatattttgctattataaataatacagtgatggtcatttgtgttcagaaaacgataggtaatttcttaattacagcatcaaattttagaaaacttttcactgaactgttatgaatggaaaaatgtaggttagatgaaagcatctattggtagagtcataggtagctaaataacatattagaaaactgtcgaccaatgcatttgtaaggtctattgaggtcttctgtgaaaagcatttgtcaataccatgttcaaatttttaatgaataatttggaaggacacattggcattgtgatggttttatctttgttctcctccagatgcattttcaccttttttctgctttactctaggccagcggtgggactgatccttacaaggtcttgtgtgcttcttatctctcttggaaccacgtcatggccatgaaaacaagc

SEQ ID NO: 73798 - DNA, 340 bp, Homo sapiens
gaaggcaggtcaggagatacagcaaattgggatctgcgaagctgaacttcctcttgttaccagattttactgcttctcagtgccctcctgctgtaaacattcccaccaggtgactccctatgtggggaaacctgttgagtaactttttttttttaactcctaaccatttctgcattacagttctcctgctctggagattttaagagttgaaaactctttgggaattcttgtaaaaagtacattttgtctcatccccaaagaatttcccaggccccttacagaatatggttgtaacaaggcacatacatactctctggcagcagttctggaggtggggctt

SEQ ID NO: 73799 - DNA, 459 bp, Homo sapiens
ttttttgccttgccccccccccccaaaaaaaaaggcctttttaccttctcatccttggagccactggcattagttatgggcctgatagtttaagaaaacttgaaaatgaactatgtgaaccggtattctccaaagtaatattttgataaatagtgtaattctttattacagtaaaaccattgcttaagtgggcaaaactctagaggataggaaaaaacactcttgaaaacaggtggtgatgccctgaaattcagcaaactgcaggggcacgtgttgttctacccaaggtcagagtgtgtcactcaccacttgatgccactcacagaccaccaacttcagaatatctaggtgtaaagctctgtacaaaagttataacagaataatgtaaataaattattatttatattacactattacataatgtaaaggctattaaaacatgtttgtcttcaaaaaatg

SEQ ID NO: 73800 - DNA, 285 bp, Homo sapiens
cttgattaatagagatttgtatttgaaagaatgccaactaacagaaaatttctagtaaaaaatggagtatatcagcaaaattgacagaattatatccaatgtggctggcataaactcccattgagataaatggatgagatagatagatacatacattgatatctactattatagatatctatttatataataactctgtcaatgactaatgttctaactatttgttttggcaagtgaggcacagtgaatcagacataaaaataccaatcattaggatgctggatt

SEQ ID NO: 73801 - DNA, 462 bp, Homo sapiens
gcccactccttgtcacagactctcctggaggctgaaacaggggcagtctgcagagaggagaggtgtagagaggcgcgatttagaaataagaaaaccaaatcgtaaagaagcctaatgtcttgttgcaacatctgaaagaaacaagatgaatatattccactaggtgggaagcttagggtagtgggaagaacatggattcaggactttgagaaacatggatttaaattttgatccccaatgcctctctgcacttcactgttatctataaaatagaggaaataaaaatactatacattcaagtcttaacaccaacagttaactagttgtgtaaccttggacaagttatgtgacctctctgtctgagcattgtcatttgtatatgagatcatggaggttaaatgtccaacctgttgtcactgtgcacctcaaaataataaataaaacatttcatctctcaatcaa

SEQ ID NO: 73802 - DNA, 5300 bp, Homo sapiens
tcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcgcccccctgttttctctctgccttggtgttctggtttcagactcccgactccccgttcagaccagagtgccccagcccctccccagcctgagtcttctccttgctctgcggggtgggctgagacttgtccttgtttcctgcagggctggccctggctcgggcagggtggggcatcaccacctcactggccttgctggaggcacagggctctgcggacctgcagccatctgtgaggcccgcggggatggggggggaggagggtggcctgttggtttccctcagagggggcaggtggcctggagagagaggggctcaggaactgggagcctggtgggtggggcagatgctccgcggcctggagtggttctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggtcctccctttggcctgagtacttttcctgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacagtagcattagaattgtggaaaaggaacacgcaaagggagaagtgtgagaggagaaacaaaatatgagcgtttaaaatacatcgccattc

SEQ ID NO: 73803 - DNA, 4775 bp, Homo sapiens
tcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcgcccccctgttttctctctgccttggtgttctggtttcagactcccgactccccgttcagaccagagtgccccagcccctccccagcctgagtcttctccttgctctgcggggtgggctgagacttgtccttgtttcctgcagggctggccctggctcgggcagggtggggcatcaccacctcactggccttgctggaggcacagggctctgcggacctgcagccatctgtgaggcccgcggggatggggggggaggagggtggcctgttggtttccctcagagggggcaggtggcctggagagagaggggctcaggaactgggagcctggtgggtggggcagatgctccgcggcctggagtggttctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggtcctccctttggcctgagtacttttcctgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacagtagcattagaattgtggaaaaggaacacgcaaagggagaagtgtgagaggagaaacaaaatatgagcgtttaaaatacatcgccattc

SEQ ID NO: 73804 - DNA, 4253 bp, Homo sapiens
  misc_feature (1)..(1): n is a, c, g, or t
nttagaggatcccatagagacccaggtctgggtctccataactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcgcccccctgttttctctctgccttggtgttctggtttcagactcccgactccccgttcagaccagagtgccccagcccctccccagcctgagtcttctccttgctctgcggggtgggctgagacttgtccttgtttcctgcagggctggccctggctcgggcagggtggggcatcaccacctcactggccttgctggaggcacagggctctgcggacctgcagccatctgtgaggcccgcggggatggggggggaggagggtggcctgttggtttccctcagagggggcaggtggcctggagagagaggggctcaggaactgggagcctggtgggtggggcagatgctccgcggcctggagtggttctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggtcctccctttggcctgagtacttttcctgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacagtagcattagaattgtggaaaaggaacacgcaaagggagaagtgtgagaggagaaacaaaatatgagcgtttaaaatacatcgccattc

SEQ ID NO: 73805 - DNA, 4857 bp, Homo sapiens
tcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcgcccccctgttttctctctgccttggtgttctggtttcagactcccgactccccgttcagaccagagtgccccagcccctccccagcctgagtcttctccttgctctgcggggtgggctgagacttgtccttgtttcctgcagggctggccctggctcgggcagggtggggcatcaccacctcactggccttgctggaggcacagggctctgcggacctgcagccatctgtgaggcccgcggggatggggggggaggagggtggcctgttggtttccctcagagggggcaggtggcctggagagagaggggctcaggaactgggagcctggtgggtggggcagatgctccgcggcctggagtggttctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggtcctccctttggcctgagtacttttcctgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacagtagcattagaattgtggaaaaggaacacgcaaagggagaagtgtgagaggagaaacaaaatatgagcgtttaaaatacatcgccattc

SEQ ID NO: 73806 - DNA, 5326 bp, Homo sapiens
tcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcgcccccctgttttctctctgccttggtgttctggtttcagactcccgactccccgttcagaccagagtgccccagcccctccccagcctgagtcttctccttgctctgcggggtgggctgagacttgtccttgtttcctgcagggctggccctggctcgggcagggtggggcatcaccacctcactggccttgctggaggcacagggctctgcggacctgcagccatctgtgaggcccgcggggatggggggggaggagggtggcctgttggtttccctcagagggggcaggtggcctggagagagaggggctcaggaactgggagcctggtgggtggggcagatgctccgcggcctggagtggttctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggtcctccctttggcctgagtacttttcctgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacagtagcattagaattgtggaaaaggaacacgcaaagggagaagtgtgagaggagaaacaaaatatgagcgtttaaaatacatcgccattcgatagggtaccagctcgatcgtatta

SEQ ID NO: 73807 - DNA, 5243 bp, Homo sapiens
  misc_feature (5230)..(5230): n is a, c, g, or t
tcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcgcccccctgttttctctctgccttggtgttctggtttcagactcccgactccccgttcagaccagagtgccccagcccctccccagcctgagtcttctccttgctctgcggggtgggctgagacttgtccttgtttcctgcagggctggccctggctcgggcagggtggggcatcaccacctcactggccttgctggaggcacagggctctgcggacctgcagccatctgtgaggcccgcggggatggggggggaggagggtggcctgttggtttccctcagagggggcaggtggcctggagagagaggggctcaggaactgggagcctggtgggtggggcagatgctccgcggcctggagtggttctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggtcctccctttggcctgagtacttttcctgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttttgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacaccgtgggggtaccgagctngaattcgaatcgg

SEQ ID NO: 73808 - DNA, 1202 bp, Homo sapiens
tcgactcataaaccaatacggtcagtagcgaggccctcccggtgttaattggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacagtagcattagaattgtggaaaaggaacacgcaaagggagaagtgtgagaggagaaacaaaatatgagcgtttaaaatacatcgccattc

SEQ ID NO: 73809 - DNA, 1938 bp, Homo sapiens
tcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggccgcaggtgccagggtttgatggacagtagcattagaattgtggaaaaggaacacgcaaagggagaagtgtgagaggagaaacaaaatatgagcgtttaaaatacatcgccattc

SEQ ID NO: 73810 - DNA, 1771 bp, Homo sapiens
tcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagggagaaggtctatgcgtccttggaggcctactgcaagcacaagtacccagagcagccgggaaggttcgctaagctcttgctccgcctgccggctctgcgctccttcgggctcaaatgcctggaacatctcttcttcttcaagctcatcggggacacacccattgacacctcctttatgattaacg

SEQ ID NO: 73811 - DNA, 761 bp, Homo sapiens
aaattttataagctgcatagaataggctttaaaatatcagaattaggaaaataaaatatagatggtaaaaattcaaatatttatcaagacttttttcttcactaatgatggggtaaagaatttttaaatggataatataaaacagacagttcaaaaattatttttggaaaatatatgcatcgggaaacataccccacacggtgccatggtttaattattccccagctctacttttgggagcctggaacttgtcagggttgtgaaatagatctcagactattaaggacattcagaaactggctaagccattcaaggaaaatcaggaatttacgtaatatattggactacagtctcaaaggacagagagaaaatcagtcaaatgggttttgatatttttttttcctagaaatgtgtagcaaatgtgattttacaaagcagctaaaaatacaactatctctctggaattgaaaatgtgtaaaataagaccacacactttcaatatgcacaaaatatattttaaatgtttaagttgtattggtaatttactatgttctcctgtagaaaatcataattaaagttggtgctcgtgttgctaaagttttttttctcatgtcaggaacttgcagcttgttctatatagtttggtgaaacaaacaaaacagtttttatctgctgtgacatttaagtttgttgttagctggagttaaatctacatacataaaagtaaaacaataaatatggaaacatcccaaaagtctttc

SEQ ID NO: 73812 - DNA, 463 bp, Homo sapiens
gtagatgggctgtacccaatctgcgaaaggtgccggctgactgtgaactgtctatacctattatcagtatttaggacacctcatcttcttatgttcactgtcacctgtctactcataagagagtatctaagatctatccctttatttgaaagtcaagtgtatttctgtgtctttgccacatcaattttacttaaagacttaattccccaaagccagaatgacaaaatccacagtttagagtcatttcttaaaatgtaaagcctcagtttaattgaagaaagctgttaggggatcttgtggtctgtgacttgaagacaattatttttctgtaacagtaatatcaataacttaaaatgttgcttctctgcctgtaatacatagtaactgtaatcatagcctttctactgaggtctttttctgccatctgataaatcatacagtagatataaactcaccccactcc

SEQ ID NO: 73813 - DNA, 692 bp, Homo sapiens
aaagattattctaatatttttaaaggattattaggtgaaaacagtacaaaagaagccaggagttaactttctgtgtgtttttttttaaatcaaccagttatttgttaaaattattttgttaacttaagatcagacaatcattcagagtgagataaatcactgaaagccctaatgactctgttgtttacaaatcctgggcttgaaatcagactttgcaccaaagagctccctgtgggggcatctttgggctgtatttaaatagtggccccttggccttgtcaccatttgtttaccatcacagcatgtgaggtcatggcctcccagatcaaagtatgctgtcattcctgccacataaaaagcatctgcagtcctaagacataaaaattccagtaggttacttgaaaacattattctagtgaaagtagtcagatacaaaaggccacatgttgtatgactccgttgatatggaatgtcagaattggcaaatccatcaaaagcagattggtggcttaggggaggggtaatgaggagtgcctactgatgggtagggggcttccctttggggtgacagaaatgttctggaactatatagaggtgatggttgcacaacacggggaattcactaagtatcactcatggtacattttgtgttatgtgtgttttaccacaataaaaaagttaaaagctggcca

SEQ ID NO: 73814 - DNA, 482 bp, Homo sapiens
ttaggattcccagaaacgggagcatggtgagacggggagggagagatgctactgacagcattgctctctccctactcctgcttaaatatgggaacaaggagaaattattaacttagccaaatcatacagagtagggtgaaactaggctcaaaaaatgaaatgaagttacatataaatgaatgaacaaataaaaagatatgcaaggccaggcgtggtggctcacacctgtaatcctagcattttgggaggccaaggtgggtggatcatgcagtcaggatatagagaccatcctggccaacatggtgaaaccccgtctctactaaaaatacaaaaattagctgggcgtggtggcatgtgcctgtagtcccagctactctggaggctgagacaggagaatcgcttgaaccagagaggcagaagttgcagtaagccgagatcatgccactgcactcctgcctggcgacagtgcgagactccgtctc

SEQ ID NO: 73815 - DNA, 464 bp, Homo sapiens
caacttttccccaagcccaccaacttggattcagattgcgacatgcaggacaggccagtcattctctctctctgactttctgtttaatcatctgtgggctaattcccccttctctggtgccataaattatgtggctcatagtaggtgcaccatccaaggagaaggtccctttttccaacttgtaatgatcactaattattattgccggctgtcatgtcagcctccttaccagccactttcctttggaaataacttttttattgttccacaaatagtatgtgctcattgtagtacattttttaaaaaccacaaatgagcaaagatttttttaaaaccttaaatgtctggccgggtgtggtggctcatccctataatcctacactttgggaggccaaggtgggcggatcacttgagctcaggagtttaagaccagcctgggaaatgtggtaaaactccgactctat

SEQ ID NO: 73816 - DNA, 766 bp, Homo sapiens
ctccccaaaacaaacaccctgcacaaagatagctttcaatgaccctgacaggcttcaaaggacgctgcggaaatctctctggaaaataggaagggccaattactttaatttcttacatgccgtctcttcctactccggtgactaccctccactctcccagctccgcctgggataattttaggctcgtggaagttgtgtctcgcagggcgccccggcccacttcctgctcccttagttggtgaatcttggaaatgtctgcagatccggcgaggagcaagagggctggttctgtaaaagcccccgtgattactgcttgtaaacttgttaaaaggacaattttctgtcacagtcataaactctttgtaaaacccctggcactaaatccagagcgcgcatattccagatgtgtttaataagaaattgcacaatgtgcctccttccgccatcctcggctcagtctgggtaaaaggggcgagcaggaggaggcgagaaagctggatattgctttgagtttttttggcaatcatttcagagagatcattaggggaaactaaccatatttttttcttccctcgaggaaatcttcgagaaccagctgttaagggacctccagtttaccttctgggcgtcgcagtttaactgaatctaaagccacttttcgtttctcctctacagatgtcataacggtagccaaaagtaatgaacaacggcttataaatagtttgtaggacgaaaccatacagcattgtgccaagtgaaatgaaaa

SEQ ID NO: 73817 - DNA, 710 bp, Homo sapiens
atgtgacaccacgcccggctaattttgtatttttagtagagatggggttttaccatgttggtcaggctggtatcaaagtcctgacctcaggtaatccacccacctcggcctcccgaagtgttgggattacaggcatgagccaccactcccggccttaactattcttttggagttaatgtttgcactgatgactttgttttatattagtatattacttagtaatacagtattaggtaaaaagattatagatccttaatgatctgtgaagggaaaggtgttttctggttaggaatttaggcagttgccatatttgtgaaaatgttcacaaagtcataattaaaaacctcggatgtggagttgagctgttttggagttaactttgaatgatattgataattggtttaagacttggtttaggaaatgggaagtgcactagtttatattacagaatatatagataattgtgagttgtaatatgacatttgacatcacttcatgactagtttttcagatcctgaaattgggctgcactgtgaaataattctaaaatttaggtaattgctgtttggtggtgaagatacttggcaagaagaccacttttacttgagtttcagactttaatctgagtttagacttagttattatagatgtaaataccaaaacggttgataatagatggatcatcctagagaaaaattttaaaaatatga

SEQ ID NO: 73818 - DNA, 631 bp, Homo sapiens
tcagttaattagtaagaggaagcagaaatatcaagggacttaagaattggcaggcatgagccaccactcccggccttaactattcttttggagttaatgtttgcactgatgactttgttttatattagtatattacttagtaatacagtattaggtaaaaagattatagatccttaatgatctgtgaagggaaaggtgttttctggttaggaatttaggcagttgccatatttgtgaaaatgttcacaaagtcataattaaaaacctcggatgtggagttgagctgttttggagttaactttgaatgatattgataattggtttaagacttggtttaggaaatgggaagtgcactagtttatattacagaatatatagataattgtgagttgtaatatgacatttgacatcacttcatgactagtttttcagatcctgaaattgggctgcactgtgaaataattctaaaatttaggtaattgctgtttggtggtgaagatacttggcaagaagaccacttttacttgagtttcagactttaatctgagtttagacttagttattatagatgtaaataccaaaacggttgataatagatggatcatcctagagaaaaattttaaaaatatga

SEQ ID NO: 73819 - DNA, 614 bp, Homo sapiens
ttggacaggatcttgctccatcacccaggctggagtgcagtggtgcgatctcggctcaccgcagcctcaacctcctgggtccaagccatccttccagatagctgggaccacatgtgcatgccaccctgactggctataattttttatttttttattctgtttctgagaccaagtctcactctgttgcccaggctggaatgcagtggcacgatctcatctcactgcaacctccgcctcccaggttcaagtgattctcctgcctcagcctcccaagtagctgggattacaggcacccgccgccatgcccagctaatttttgtactttttggtacagatggggtctcaccatcttggccaggctggtcttgaactcctgacctcaggtgatctgcctgcctcagcctcccaaagtgctgggatgacaggcgtgagccactgcacttggccttatatatatatatttttagagatagggtctcgctatgttgcccagggtggtcttgaactccttggctcaagtgatcctcctgcctcggcctcccaaagcactaggtttaactgacatgagccactgcgcccaggctggtgtgtgcttttatttaaattgttccgca

SEQ ID NO: 73820 - DNA, 1343 bp, Homo sapiens
  misc_feature (120)..(120): n is a, c, g, or t
gtttccatatggaaccatctgtgtgaattagtcatcagttaggtatagttaacgtaaagagcccctgccattgaaactttgcacaccttctctgctttattgaaggcaagggccagtggnagtgatagcaggggagggctcctccaagaacccccccagcctccagagggccaataagcatggatatcatgtcaggagctgagctgacatatatttactcagaggacattggggtctgtagctaatcctaaagaatgctccgcaacagaaggaaaccaatgcattgtagaaaacaaagggagatggtgcccgaagtctgcctgtttctcttctcttttctttcccatctcaccaccatgtcctctctaacagaattatatttcatctcatatattatatgttactagaaaagtcatttggttccttggtttctctctttatcagtgggctggaaattcctccaaattaaatataactaccagtagcagctcccctgtgtccagccagtttctcaaatgctgtccacctggtcttactgtccacctaacataacttggaggctttggctggctcaaccacctgttcactttattttgttttcatttccatttgaacttgaagtgaggctatggaaaggtggaaatcatgggcaaggtttggaggctgcaattctagggcatagcttgtcaggagtttatattatctaaaatatatctttctataccccttttcattttaatctgttgccctgattataatttctttatatttgtggttatttttataagaatagagtccatttgctatgtctatttgagtactttttttctattgtccccacatggatgcagtaccaacctgttaatgaaatatctttttattatattattaatatgtaattctactgtagaccaaaaatataaaaacaaatttgttcattttaaagatataaagaactagggagtaaaagattaaaagttgaaggaaaagacagaagagcagtggttaactatgttgagttagaaatctaagagtagccttacctgttttttaaccagtgcttgccaatcataccatagttggaattatgtaatcttggctccttcatacttatgttctataattcttgtttgtctatttgttttctttgatgtaattgaggttgcacatcatgctattcttggcaatgcctgattctattgtattgtacttttgttagtcatttcctttagaaagatggggggaaacgtttatttcttcttttaatttaaaatttgtttaatgcactggaaataaaattggacatatttcactgtttaaaaaatcagaaacaaaacaaagca

SEQ ID NO: 73821 - DNA, 2023 bp, Homo sapiens
  misc_feature (2)..(2): n is a, c, g, or t
tnggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacatggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgctttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaactatgactctataaggttttcaaacatctgaggcatgataaatttattatccataattataagagtcactctggatttcaaaaatgtcaaaaaatgagcaacagagggtccttatttaaacataagtgctgtgacttaggtgaattttcaatttaaggtagaaaataagtttttaggaggtttgtaaaagaagaatcaattttcagcagaaaacatgtcaactttaaaatatatggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtgggaaggcctttgaatgtaaagctgcataagctgttaggttttgttttaaaaggacatgtttattattgttcaataaaaaagaacaagatacagcttctctgtg

SEQ ID NO: 73822 - DNA, 2096 bp, Homo sapiens
  misc_feature (2)..(2): n is a, c, g, or t
tnggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacatggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgctttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaactatgactctataaggttttcaaacatctgaggcatgataaatttattatccataattatagtaataataaccttaataagcataagaaaaacagagtcactctggatttcaaaaatgtcaaaaaatgagcaacagagggtccttatttaaacataagtgctgtgacttaggtgaattttcaatttaaggtagaaaataagtttttaggaggtttgtaaaagaagaatcaattttcagcagaaaacatgtcaactttaaaatatagtttattttcatatttttttcttttaaacttggttgataagtggaattaggagtatatttgaaagaatcttagcacaaacaggactgttgtactagatgttcttaggaaatatctcagaagtattttatttgaagtgaagaacttatttaagaattatttcagtatttacctgtattttattcttgaagttggccaacagagttgtgaatgtgtgtgggaaggcctttgaatgtaaagctgcataagctgttaggttttgttttaaaaggacatgtttattattgttcaataaaaaagaacaagatacagcttctctgtg

SEQ ID NO: 73823 - DNA, 641 bp, Homo sapiens
gggatcacaccctttgggaacacatccaagcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73824 - DNA, 675 bp, Homo sapiens
gggatcacaccctttgggaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73825 - DNA, 526 bp, Homo sapiens
gggatcacaccctttgggaacacatccaagcttaagacggtgaggtcagcttcacattctcaggaactctccttctttggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73826 - DNA, 725 bp, Homo sapiens
ggcaggagctacccttcccgtggccccggaccttgggtgggctgtgggctcagggagcggaggggaggccttaagcatccactctctgcccggtgtttttgttctcatcagggagcctcagatgggaagggactcgagccccacctgtccctggactctggaatgccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73827 - DNA, 728 bp, Homo sapiens
gggatcacaccctttgggaacacatccaagcttaagacggtgaggtcagcttcacattctcaggaactctccttctttggggagcctcagatgggaagggactcgagccccacctgtccctggactctggaatgtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73828 - DNA, 969 bp, Homo sapiens
gggatcacaccctttgggaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttaaaaaaaaaaaaaaaaaactccggggcactcaatgccggggggcaaacgaggtcacggaaggcgcatgggataagtggttctggaccagtttcggtacaggggaattggcggtccccaaagggacgaataattcgaaaggcggtaactgtagctgtcggcaaacgaaagacacaagacgaggcgggggacacaatgtcaacacggggggagagcacactagaaacatccacacgagcacatcacgtcaaaacacgacgagacttgcaggcaacagagagacacgacgacgacga

SEQ ID NO: 73829 - DNA, 540 bp, Homo sapiens
cgtgcccatagtctctcccaagctcaaagttcacctctttctccagatcccctggggtccccaagcctgactcagtgtatctgggggggtcccttctgagcccacgcaccgacccagctcctcttccctgcagtggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73830 - DNA, 740 bp, Homo sapiens
cggggcttgctggggagggcgatgaggagggcaagagcctccaaggacccagtcccaatctcaaccctatgaacctcaatctccctgttcctctgtctctctctacacattctctcagggtttctctgagggagatggaggagggagggaaggagcccaagccaggaacagtgcactcaggaagactcagcccgaagcagatttgctgggttacctggggcgtctcctcccctctggggtgcagcctccttccctgaagagcgaggctgcttctagctctggagttcaccatgggggttcatgcctgcagcagcctctccccaaacaaagaccccgagggtactgggaaacagagaggggaactgggtggggtctgtaagcctcagcccctgctgagggtcactggagtctctgaccccacagtcctgcccacagagcttccccgacaggcatgtcccactctgtccaccctctgcttcttcccaggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73831 - DNA, 869 bp, Homo sapiens
gggatcacaccctttgggaacacatccaagcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttaagaaaaaacaaagaacaatcaatccaagcactaagcacaaatcaaagaagtaaatatatgacataacagtataaaagagaagggggggggccgtgtatatgaatatcccagtgggaggggcgacatattcgtctggcgcaccattgttttgtgagacagggggccccgtaagagagggtcgtctattgatacgaggacggctcggtgttttataaggtctttggtgaaacacgtctctgtgtgttctcgttg

SEQ ID NO: 73832 - DNA, 404 bp, Homo sapiens
gcggccgcctactactactaaattcgcggccgcgtcgaccaagttcatcctgggcttcattgggtctgccattgcggctgtcattgcgaggttctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggggagaaggcacccagccatcctgacccagcgaggagccaactatcccaaatatacctggggtgaaatataccaaattctgcatctccagaggaaaataagaaataaagatgaattgttgcaactctt

SEQ ID NO: 73833 - DNA, 849 bp, Homo sapiens
  misc_feature (795)..(795): n is a, c, g, or t
  misc_feature (849)..(849): n is a, c, g, or t
gggatcacaccctttgggaacacatccaagcttaagacggtgaggtcagcttcacattctcaggaactctccttctttgggtctggctgaagttgaggatctcttactctctaggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttaaaaaaaaaaaaaaaaattaatatttaggacacttcagagcaccttatacttctaatcagattttgggtaactggttttaaagtgttacttgaatatttttctcatactggctttcaggnaaagtacttctcagagacttgttaagagatgttaatttgattaaacaagttatn

SEQ ID NO: 73834 - DNA, 815 bp, Homo sapiens
  misc_feature (761)..(761): n is a, c, g, or t
  misc_feature (815)..(815): n is a, c, g, or t
gggatcacaccctttgggaacacatccaagcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccagaggaaaataagaaataaagatgaattgttgcaactcttaaaaaaaaaaaaaaaaattaatatttaggacacttcagagcaccttatacttctaatcagattttgggtaactggttttaaagtgttacttgaatatttttctcatactggctttcaggnaaagtacttctcagagacttgttaagagatgttaatttgattaaacaagttatn

SEQ ID NO: 73835 - DNA, 659 bp, Homo sapiens
gggatcacaccctttgggaacacatccaagcttaagacggtgaggtcagcttcacattctcaggaactctccttctttgggccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtggctactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctggggtgaaatataccaaattctgcatctccccaggccttttaatattaaaacagaattgttgcccctctggattaaaaaaacaaaagg

SEQ ID NO: 73836 - DNA, 299 bp, Homo sapiens
gggaaataaagtccctcagggccctgacctaacacaggtcctttggtagccccaactccccaacatccctccctccctcaccccaggatcctttcaaggcctgctgctccacaagctcagagcagcctccctagccccctggagcccgtcacatttttcaggacagtgggaagcaagtcaggttgtgtgcccatcccgtcctcagagctccatcccttcggcaggtctggctgaagttgaggatctcttactctctaggccacggaattaacccgagcaggcatggaggcctctgctct

SEQ ID NO: 73837 - DNA, 654 bp, Homo sapiens
tccagcccaccctccacaaaatggtatactatttgaaagcagagactgttgatcttattcactgaagtatttctatgtctagaattgtgccctgcacttagttgctactcaataaatgtttgcagagggacagattgacacatagtagatgtaaatgttaccagctctctgcaatgcagcacattgaccttccctagtcctatccaagaagtagattctagacatatcatgtcatgttatactttgcatatctctgttacccaggtaacagcaggtttctttgtatttgacatccctgcaaacttgggtgggcagcagagaaccacagcatagagggctgaggaagaagacgtctcgcagaaggcactgggaccaggggactgctgttgtcttttgctcactgtgtggcttagaaagcaaaagaggatcccagacactgtgcacagttatggtgtgagctcagccaagggggattggagcagatgatgaccaaatctgaaggccagccagtggggagggggttccagccatggggcttctgtcccaggaagggcgctcgtcctggatccagtaggaacaagcaagagagccaggctacaaaaagaaaccatgtaggttttcaaaaagaaaaaccatgtaggctttgaaccagga

SEQ ID NO: 73838 - DNA, 587 bp, Homo sapiens
acttgtgaaaattctcaccaaaatgttcacaagttcttttgaaggagaggggatgtggggagggagaagaggttatatgagattgtctttaatgttttgtactttttgcatttttaagctttttgacaacatgtattttataatcagagaaaaatgctgacttttataaagtgccattattatgattatgagctgcctcgtgtgtgtgggcatgggtttgccatgaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagcaaattaatttcagtgttcttatttgtctttgaattgtttctttttaaaattttactggttcctttataaatttacctttttgaaaaagtattg

SEQ ID NO: 73839 - DNA, 2075 bp, Homo sapiens
aaaaaggcagaaacttttaaaattagaaattggataatttttaagaatctttagagaaaacattggtttatcatagtctttttctttcattgagttttcatttagactagcatggcaagcagggtggccttggactttgatttaggggatcgtgctttggcctggaaaataagcactggcctgcatgcctagaacctgagtgaaggcagtcaacatcctagtatgaatcagacctagcagaaatgtaaattatttcaagtacttcagggtttagttttcttagtgacaccctggaccctggatgctgctttctaaagtgcacctgatccatgcagttttatgtcttcatataactggtatcttgtgagtttgcaagcaatgggatgagcaagaaaaaaaggacgcatggaggagaaaaatttgaacgaggctagtgcaatgttttgctgatagattacattgttagggagctggtgattttttgccatggtcgtatcgtggacagcttttccgtggaaattcaaggcatctgtattaggcaaatgtgagtgcccttgatcttgtattgatcagtgccaatgtactgggaaagcaggtaccccagtgaaactggtctgtgcttggtttaacagctccaacaatttcagatccatggggctgcttggccatagaccctgtttactccatgcctgttcaaaagtcattttgacttctagctttgtttcactttcttctttcaatacttctgtttccgcgtccttttccttcatattccatggctatttctttcctactttacagtttcccccagacccagattttttcacacctctgcatcatagacaactgagtatctcccttggcccctcctccatcctctcacaccctgtgctccattcctcagccgtttggacagggagctccgctgtcaccaaggagcccatgtgagacacactgctatgactgcctcttgttaatgtcagcatcacctcatcacttaagcaaaaggaaaatccataaaagagatggaaaatacgtctctttttattttattttaagaagattgggcggggtggggggggggttcttattctaggccttctcaatttctcatagattttaccttaaactaattaaggccattctcttgataaatttgtacatcagaccgggtcaccagctatgatgcagaacgccagatttttgaatctcaagtaactttctgtgctgctggacaaattgacttaattctgtgcaggcaaacactttgaatcataaggatttttattgccactccattcttactactattcatgattcaaacatctacccctgttctgaatcaggatgttgacacttcttggttattttcagatgaacagtaactgctacactcttgaaagcacttaaaagtgcaagcatgtcctaaatagccatttaacctggtaaaacataggcttttctgtttaattaagtattagaccagtctgtagatataatctgaaaagattttaggcagtaatgaagacagttggggaaaggagaaggccctttaaagacatgaaaccttacacgctcttgggatatttttaagcataataagctcattggattcaggtatttttccctttgcatttttaaaaatacgtatttctaatttgtttgcatatttaattttgtcaaagctgagaaatgctcatgagttgaatttataaatgtcatttgcaaccaaatgaagtatttatttttaaaaagagagtgaaggaaccaacactgatttgtacataataaaaatgtgtgtattatatatatattttttttcctccttgacagtacttggtcacaatatcaagtgtatttttgtacataatatatattgattagaaaaacgtcaattgtctattcaaaaaattctatctctgtgatagattatatttatcctaatctgttgatacctctgttaatttgttttaagagatagaattatattttttggaatttacagagaattgcattcatggctttcaattgtaaatatgctaagagtattttaataaatcttggtttcatgtcca

SEQ ID NO: 73840 - DNA, 969 bp, Homo sapiens
gcacttgtctattaagtaaaggagttaagtgtttcttaaaagggctattccaagcatgacgtcttttaattttatgcttagccagcctccaaatctaaagccatctgtaaagaaggtagtaatcctctcgtgaaaatgcaggggccatagatgtcaaatgcatattgttctgattgattgattgattgattgagaggaggtcttgctctgtcatctaggctggagtgcagtgacccagtcatggcttactgctgtcttgacttcctgggctcaggtgattgtcctgcctcagcctcctgagtagctgggatcacaggcacatgccaccacgcctatatcatttattattattattattatttggagagatggagactccctctgttactcaggctggtcttgaactactggcctcaagcaattctcccaccttgaagaacaggattttcaagttcttctctgggcttcagtttccttatttggaatatgtggataataactgcttaacaaagtccatttaggatcaaatgagataatgtatgtgaaaatactgtgtaaattatgaaaaatgtatacctaatacataaaactctttgcactgcataatttttggaaattaccttgaggggctgagtgcggtggctcatgcatgtaattccaacactttgggaggcaaagtctggaggatcccttgagccttggagttcaagaagatcagcatgggttacatggtgagatcctgtctctacagaaaattaaaaagaaaaaaaagaaattaacttgaggaactaaaggcctaatcactatataaattcatggtttaaaattaagtttgttcctggctctattttatgtctctaccttttttcctatgtatgattcataatattttgttatattttctataaacctataatctcttaaatcttcgaaaaaatacagggtataaataaaaatcacataaacctc

SEQ ID NO: 73841 - DNA, 4518 bp, Homo sapiens
agcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagtggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacgcactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctggtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgaaaaaaaaaacccccccccccc

SEQ ID NO: 73842 - DNA, 439 bp, Homo sapiens
atagttcccaccatgacctttgcagacttgccctcgagcactggaacagcctcgccagtacaccctcaatcctgcagctgctcactgatacaggaacccagaagcccagctccttgcctgtgcgctacagctccccacgggctactcagaagctgtggtttcatctgaaagcgcacccttgtttggctcctttcatttccgtgtcctgtttcatacccctcaccccatactgctctcccctgggagcacttccttcacatcatttgctcctgaactcttggctccgttcttctgagagaatcttaatgcaatgcacaaaaaggcataaaagaggcaaatactaataaactcactttggtattatggactttggtgttaacttgtgttttttctttttttaaaaaaaattgttaattccaaagtaatacgtgtacattgt

SEQ ID NO: 73843 - DNA, 356 bp, Homo sapiens
tcttttggtggggagtatgtttatcagatgacagtattactgatactctataccttactgaaaagctccaagcacattcatgtgcactagatcaatgattaataagaataaataataaacatggagatggataagttttactgtaatcgttttacctctcacacattaagctccattgctttttcttcatacaagaggcaccttacaaaataaataaataaatctcctttaggtataactggtggaattccctctctaaggagcaggcattggcattataaaactataaaagtcaatgatttctgaacttattcccctttaatactttaaccaaacttaacaagtaccatgcttac

SEQ ID NO: 73844 - DNA, 876 bp, Homo sapiens
gaataatcattcgtttagtaagataagatgaaccaaggaagcccatggtaagaccgtgtaacctcctaggtatcggagtatgaaggtggtaactttcatattgagagcttgagtccctctggtgcaaagcatagaatatgaactttaagtatctttgttacaatctatatattttattttcttatggatattaaatatttcaggaacattagagcttctctttctaagggagagaaaaggggataattatactgtctgacttctatgaaaaataaaagtttaaaaacaaaacattgggagtagagagaggaatgatgcttcctagctagtgtaataactgttggaatattattaaataaattcacatgtttgccttagggtatatgttggaaccagaccctgacaaaaggccggatatttaccaggtgtcctacttctcatttaagctactcaagaaagagtgcccaattccaaatgtacaggtacgtgaatggtgctatttaaagggagtaaacattatcaaattgccattttgagctcctggggtgttaatcagctgtttaaatgaatttagatgtcccttgctttatctactgggggtagtcaagcaaagctaactgtgaagcagttgccataaagggaatccagttttcccatggaatttaattataaaactgaagcaattgtactgaacaaaaaaatgccctagggattgagttggacgctttggatgaagattgaccaacttcatgtctgtcaactcttctagttctctgagagccacatgcctgttgtagtcacctggaggtgattacaggcaggctactttcccgaggcaatgccttggacatgcccccatgcctgttagaacctacg

SEQ ID NO: 73845 - DNA, 795 bp, Homo sapiens
ggactcagcagaaaaacagagcaaactattgatacttgcgaccacacggatgactttcatctcaaaggcattatgccaaaggaaggaaaccacacacaaaagactacatactctgtggttccatttataggaaattctggaaaaggcaaagctgtagggacagaaagcagatctgttgttaccagggtctgtggtgagaggaaggcactgactgtaaagggttatgaaggaattttctcaggttttggaaatgttctgtatcatttcagtggtaatgatatgaatgtatacatttgtccagactaaccacattgtacacttaaaatgggcgacttttattgtatgcaaattacacctcaaataaaaacaagcagacgcacccaggacagcatcttgaatgccttacaaagtgactacttcacttgaggaagtaatcatttttaaacttccaattttgaaaacctgttgttaacaagatattaatagcattcatttttatggtgaacctgtaccaaatattgacccctaaaatgtgtttgcttaaagaatagtgaatgatccgctggctttaatatcttactacatttttgctttctttttgtctctctgcccaacgtagaaaaactaattgagggactcaaatctcctgacacttctcttctgctcccacgagccgctcttagggtggtcagcggcgcaggtcacaaaactgggccataggcatgaaagtggcaggcacaattttcatgagtttggccaagacgctcttcgtagaaatcaggttctggttgggct

SEQ ID NO: 73846 - DNA, 2107 bp, Homo sapiens
gaggtacccggctcgacttaggtcggactctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactgctgaaaaaaggaagggtgggcagactgtggactctggcctcccgcttctaagcgtgtctgatcctttcattcctcttcaagtacctgatgcaccagaaaaactaattgagggactcaaatctcctgacacttctcttctgctccctgacctcttgcctatgacagatccttttggtagcacttctgatgctgtaattggtaaagtcatcatctctgtttcttcagtcatgcatgatatgtgtgcctgtttcaagaatgacaagtacctagttaaccaatccctggggaatagccctgccaccccagaagccaaggctatttaatctcacttgtatcactccaaatgaagtgttttccttgcttttcgggggtacaacgtctattttttgcctttcttgatatctggagatttctagagtggatctcttatgaatgaggaggaatgtggaaagtttcacatttagttagaagaactttaaaaaattggtttctaactagactacctttactgaacttaatgaaatttagcagattcttcttttttttttttttgtttgagacagagtttcactcttgttgcctgggctggagtgcagtggcaagatctcggctcactgcagcctccatctcccgggttcaggcaattctcctgcctcagcctcccgagtagctggggttacaggcgtgcaccaccatgcctggctaatttttatatttttagtagagatggggtttctccatgttggtcaggctggtctcgaactcctgacctcaggtgatccgcctgccttggcctcccaaagtgctgggattgcaggggtgagccaccatgcccagcccagattcttctttggaaggcccatgtacatccagctgcagtgggacgagcctgggaagcatgggaagaccccatccctacaaaaaaagtgttgttaattggccaggtgtgggggtgcacgcctgtgctaccagctctttgggaggctgagacggaagatcactttgagccagggggtttgaggctgcagtgagccctgatcatgccactgccctccagcttaggtgacagagacccatcttaaacaaaattaaaaaatttaaaaaggtccatgtatataccaagtatcagtaactgagaaaacattttgcccactggttaagccccataaatagaatccagggcaggggcttggtctgcttcctctctcacattttcctatgttccaacagcaaggcaggcaagatttgcaaaatgtccaaggcccctgtactccaggagggtccaatcatgaggcacctaataatgcctttgggcagaaagtcctagaactcagaagtgccatgaccttgcataggggtaggcctgcagctgaggggtgtcacgtggtgcaaaaggcctcccagctacatcctgggatggggtttgagatggattaatggcctttgcatggcacagaggatgtttgcccccaggtttatcccttaataaaagtgaaattaccagaaaaaattaaggtgcctttcagcccatctcttctgacatggaagaggtttgctgagcggcttatgttctgaatttgtttatgagaactgatcattagtgagactggccacagtatttaaccttgcacatgcatgctcagtgaagcctagacattcagagcagcagaaataaagtaacttatttttctttccaccttgcctgagactggcattttagagacctgttaaaagaaagtcttcacatggctgggtgcagtggctcacacttgtaaccacaggactttgggaggccaaggtgggatagatcgcttgagctcaggagcaagacaccatctcaaaaaatgagaatt

SEQ ID NO: 73847 - DNA, 4869 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagtttcaggcagtacatccagcaacccagcaaccagcaattgctcagttccctgtggtgtcccaaggaggctctcaacagcagctaatgcagaatttctaccagcagcagcagcagcagcacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgcagattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactgctgaaaaaaggaagggtgggcagactgtggactctggcctcccgcttctaagcgtgtctgatcctttcattcctcttcaagtacctgatgcaccagaaaaactaattgagggactcaaatctcctgacacttctcttctgctccctgacctcttgcctatgacagatccttttggtagcacttctgatgctgtaattggtaaagtcatcatctctgtttcttcagtcatgcatgatatgtgtgcctgtttcaagaatgacaagtacctagttaaccaatccctggggaatagccctgccaccccagaagccaaggctatttaatctcacttgtatcactccaaatgaagtgttttccttgcttttcgggggtacaacgtctattttttgcctttcttgatatctggagatttctagagtggatctcttatgaatgaggaggaatgtggaaagtttcacatttagttagaagaactttaaaaaattggtttctaactagactacctttactgaacttaatgaaatttagcagattcttcttttttttttttttgtttgagacagagtttcactcttgttgcctgggctggagtgcagtggcaagatctcggctcactgcagcctccatctcccgggttcaggcaattctcctgcctcagcctcccgagtagctggggttacaggcgtgcaccaccatgcctggctaatttttatatttttagtagagatggggtttctccatgttggtcaggctggtctcgaactcctgacctcaggtgatccgcctgccttggcctcccaaagtgctgggattgcaggggtgagccaccatgcccagcccagattcttctttggaaggcccatgtacatccagctgcagtgggacgagcctgggaagcatgggaagaccccatccctacaaaaaaagtgttgttaattggccaggtgtgggggtgcacgcctgtgctaccagctctttgggaggctgagacggaagatcactttgagccagggggtttgaggctgcagtgagccctgatcatgccactgccctccagcttaggtgacagagacccatcttaaacaaaattaaaaaatttaaaaaggtccatgtatataccaagtatcagtaactgagaaaacattttgcccactggttaagccccataaatagaatccagggcaggggcttggtctgcttcctctctcacattttcctatgttccaacagcaaggcaggcaagatttgcaaaatgtccaaggcccctgtactccaggagggtccaatcatgaggcacctaataatgcctttgggcagaaagtcctagaactcagaagtgccatgaccttgcataggggtaggcctgcagctgaggggtgtcacgtggtgcaaaaggcctcccagctacatcctgggatggggtttgagatggattaatggcctttgcatggcacagaggatgtttgcccccaggtttatcccttaataaaagtgaaattaccagaaaaaattaaggtgcctttcagcccatctcttctgacatggaagaggtttgctgagcggcttatgttctgaatttgtttatgagaactgatcattagtgagactggccacagtatttaaccttgcacatgcatgctcagtgaagcctagacattcagagcagcagaaataaagtaacttatttttctttccaccttgcctgagactggcattttagagacctgttaaaagaaagtcttcacatggctgggtgcagtggctcacacttgtaaccacaggactttgggaggccaaggtgggatagatcgcttgagctcaggagcaagacaccatctcaaaaaatgagaatt

SEQ ID NO: 73848 - DNA, 2168 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcatacaataaaacttagtatgaaacttt

SEQ ID NO: 73849 - DNA, 2468 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtgggtgctgccaggatgccgcctcgaggggcggcggggagacccgggaggagcgggaggcagtgcccgggagggtcggcgctgccggagcagctcggatccctcctttctccgagctcccggctcgggggtcccgggttctggggccggggtcgcgttttcagccccacggtttttctcgccgggaaaatacatgaagcgtttccccaggatgatggcttttgctccccctaggactcagcggttgaatttttaagcgtgttactgattcatcctctctttcttcctctgtcatcacaggtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcatacaataaaacttagtatgaaacttt

SEQ ID NO: 73850 - DNA, 1992 bp, Homo sapiens
gaggaaaaaaacagcagaatctatttttcattgtgggagagcccaggttgtcctgcttatctgaaattaagcccaaatcctaaaatttctgaatacctgctgtcagcttcctgcaaacgggccaggttgcctaaggaatgtcatgagagagctggcagaggcaggggacaggacaggcaccagcaaacaccacttcaccatgcagctattttcatgtcctcccagcccactgaagtgctgataatggcttggatcaattcaacaaacacatttcgtatacctcctttgcaccagacagtgttcaccgaggcacgcagggtggccgcaggtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcatacaataaaacttagtatgaaacttt

SEQ ID NO: 73851 - DNA, 3039 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagtttcaggcagtacatccagcaacccagcaaccagcaattgctcagttccctgtggtgtcccaaggaggctctcaacagcagctaatgcagaatttctaccagcagcagcagcagcagcacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgcagattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactggttagtatggcaaatacctggaa

SEQ ID NO: 73852 - DNA, 2389 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacacagcagcacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgcagctcgctcctgagttgggatcctctagatc

SEQ ID NO: 73853 - DNA, 1871 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctccctaacatcttacaaagtcttatcaacaggaatattaatattattttcagtatcagaaaaaaaaaaacagttgagcagcacaggcaaaaatatatctgcactacgtttctgtcgttgccaaaaatatacacatcttcttttctt

SEQ ID NO: 73854 - DNA, 1668 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagacctgactatagccgcatccaaagcgggatcctt

SEQ ID NO: 73855 - DNA, 1533 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaagtaagctttttctcctttcatggagttttgtccacaatcagatgagcaactttaccttcagcttatggatgagaaggtcagggtggggagagaatggtgatagtcagttgtccttcatctcagagcatcatg

SEQ ID NO: 73856 - DNA, 1087 bp, Homo sapiens
  misc_feature (1087)..(1087): n is a, c, g, or t
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcaggcacaagaatatttggggttagtctgggggtcctctagagtacccgn

SEQ ID NO: 73857 - DNA, 121 bp, Homo sapiens
ctgccagcaaatcaacccagctgctccaggcagctgcagctgaggccagtctcaataagtccaagtatgtggtgcttcctctttgttgttcttacctctgtgggcaaagtcctggcggctg

SEQ ID NO: 73858 - DNA, 540 bp, Homo sapiens
agggatctttcagggcacaagaatattgtgggttacattgattctagtatcaacaacgtgagtagcggtgatgtatgggaagtgctcattctgatggacttttgtagaggtatgtatatgaaccattcccttaagctgtcatttctctagcattttgattgtcatggttagggtggtcatttcacttaatgtgcactgcactctatgatatgttctggtttgacagatgagaaaactaaaagatacagtctgctgtcaactcttagttattcttataacggtacaaacgtagataatatagaactccatttttgttaggtttgggaaggtttggtgtttgtatataaatgaagatgtgtaagaatgagaatgaatatgttctttgtgatgctttataacaaatgatgaaggcacataataaaggctgaactccagatggatgaaagaaacagtgcagcttccccaactccctcacttgtgtgttctctttcccactcatgccatcattcatgtgttacggggtaaaagcatcctttttgt

SEQ ID NO: 73859 - DNA, 744 bp, Homo sapiens
gctcctggtttttaattatagtattgacatatttaataaaaaatgaatctcttgattgtagatacacaacgctgtcctatcgagcaccagaaatggtcaacctgtacagtggcaaaatcatcactacgaaggcagacatttgggtaggtgtcaggtaacctatccatacctcagatagcagcagtcttgactgtgaattcccaaggttaatgcacacagcgctatagcatggtggctactgtaccatatcatggtctacttacccctcaaggttattcttgatgtgagaataccagccactgcttcttgaagcatgataaagaaaattacttccaagctctgtgaaaattatttagattttttttcatgtatatgttactggttcttaagagcaaaacaggtaaatacttattatttactggaacacgatttggtaataatggtagaaataatgtaactcagctgctaacagtggtgttgggttctaaaactcatgtttctaatacattaatagtctatagtttttgtatctgctagtaaatgtggatggtgccagtttctcattagatccatttagagtcatgataaataagccactagtagcaatctgctatctttattttttaggctcttggatgtttgttgtataaattatgctacttcactttgccatttggggaaagtcaggtggcaatttgtgatggaaacttcacaattcctgataattctcgatattctcaagac

SEQ ID NO: 73860 - DNA, 1951 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcatacaataaaacttagtatgaaacttt

SEQ ID NO: 73861 - DNA, 2387 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagacaccacccctatcccctgcctccccatctcagaagagggtggaagatgaaatgaaagctatgggactcttggaggatacccagtgtctattctgggttagagaagtgcttactaaggggttttctaataaaaacaaatgccaca

SEQ ID NO: 73862 - DNA, 1833 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcggaggagggggcagcacctcgggcctgggcagtggctacatcggaagagtcttcggcatcgggcgacagcaggtcacagtggacgaggtgttggcggaaggtggatttgctattgtatttctggtgaggacaagcaatgggatgaaatgtgccttgaaacgcatgtttgtcaacaatgagcatgatctccaggtgtgcaagagagaaatccagataatgagggatctttcagggcacaagaatattgtgggttacattgattctagtatcaacaacgtgagtagcggtgatgtatgggaagtgctcattctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagatgaaggagatctacaccagcaaacacatctgg

SEQ ID NO: 73863 - DNA, 1959 bp, Homo sapiens
agccgggtactctgaggatcccgctgactgtgctgatctgatggacttttgtagaggtggccaggtggtaaacctgatgaaccagcgcctgcaaacaggctttacagagaatgaagtgctccagatattttgtgatacctgtgaagctgttgcccgcctgcatcagtgcaaaactcctattatccaccgggacctgaaggttgaaaacatcctcttgcatgaccgaggccactatgtcctgtgtgactttggaagcgccaccaacaaattccagaatccacaaactgagggagtcaatgcagtagaagatgagattaagaaatacacaacgctgtcctatcgagcaccagaaatggtcaacctgtacagtggcaaaatcatcactacgaaggcagacatttgggctcttggatgtttgttgtataaattatgctacttcactttgccatttggggaaagtcaggtggcaatttgtgatggaaacttcacaattcctgataattctcgatattctcaagacatgcactgcctaattaggtatatgttggaaccagaccctgacaaaaggccggatatttaccaggtgtcctacttctcatttaagctactcaagaaagagtgcccaattccaaatgtacagaactctcccattcctgcaaagcttcctgaaccagtgaaagccagtgaggcagctgcaaaaaagacccagccaaaggccagactgacagatcccattcccaccacagagacttcaattgcaccccgccagaggcctaaagctgggcagactcagccgaacccaggaatccttcccatccagccagcgctgacaccccggaagagggccactgttcagcccccacctcaggctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagtttcaggcagtacatccagcaacccagcaaccagcaattgctcagttccctgtggtgtcccaaggaggctctcaacagcagctaatgcagaatttctaccagcagcagcagcagcagcacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgcagattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactggttagtatggcaaatacctggaa

SEQ ID NO: 73864 - DNA, 1189 bp, Homo sapiens
aactcaggggcgagctgcagctgataaaacgtgccctgccggctgctgctgtgctggcggtggctgttgctgctgctgttgctgcttgaggaagagttgctgcaggatccagcaatcagcctggccttttagccagtgttccccaaccaaaaccccaagccccacccagccagcctctgccgcaaactcaggccaagcagccacaggctcctcccactccacagcagacgccttctactcaggcccagggtctgcccgctcaggcccaggccacaccccagcaccagcagcaactcttcctcaagcagcaacagcagcagcaacagccaccgccagcacagcagcagccggcaggcacgttttaccagcagcagcaggcccagactcagcagtttcaggcagtacatccagcaacccagcaaccagcaattgctcagttccctgtggtgtcccaaggaggctctcaacagcagctaatgcagaatttctaccagcagcagcagcagcagcacaacaacagcaacagcaacagctggccacagccctgcatcaacaacagctgatgactcagcaggctgccttgcagcaaaagcccactatggcagcaggacagcagccccagccacagccagctgcagccccacagccagcccctgcccaggagccagcgcagattcaagccccagtaagacaacagccaaaggttcagacaaccccacctcctgccgtccaggggcagaaagttggatctctcactccaccctcatcccccaaaacccaacgtgctgggcacaggcgtattctcagtgacgtaacccacagtgcagtctttggggtccctgccagcaaatcaacccagctgctccaggcagctgcagctgaggccagtctcaataagtccaagtctgcaaccaccactccatcaggctctcctcggacctctcaacaaaacgtttataatccttcagaagggtctacgtggaatccctttgatgacgataatttctccaaactcacagctgaagaactgctaaacaaggactttgccaagcttggggaaggcaaacatcccgagaagcttggaggctcagctgagagtttgatcccaggctttcaatcaacccaaggtgatgcttttgctacgacctcattttctgctggaactggttagtatggcaaatacctggaa

SEQ ID NO: 73865 - DNA, 841 bp, Homo sapiens
atgtggaggccacacggctgccgcctcgccctctcctccaggagtatgctgggattgtagtccagcagccggactgtgccgagctacctttcccagcttgccctgcggctcgggtgatatcaacagtcttttccagaactctgtctgcactgagaccctcttcccccagtcctcttctcgcggtcgactccttcccatccgtggcgacagaacggcggttgcaggagaggccccggtccctcgccgcgccgccccgaggggcacttccggcggcggttcacttcctggttgggtggatggagccgggcgggagcgcgcgcgggggaggggcggcgggtcagtctccgcccggcgctcccgggatcagctggcgggcgggcgggagccgagcgcggccccggctctcgctgcagcgccgcctcttctctgcgtcgcaggccggcccggcggccgtgacaatgtcgcggggctggtagcagggcgccggccgccgagccgtctcaagtttaaacttacacgaatcgctttctggaggaggaggggacccgctgcgcgattgacacgcatattcctataggcatcctccctcagcccccacccccacggccggattcgggtggctcctctccgaggtgaaatctgagaagaaatccttggatctcttttcttaaaaaaaaaaaaaaaaaaaaaaaaaaaaaaatctagaaaccatcggtattttgctttgctgctccctattcgcaagatgaagaagtttttcgactcccggcgagagcagggcggctctggcctgggctccggctccagcaggtaatctccagcaggtagcacagggtgcgag

SEQ ID NO: 73866 - DNA, 951 bp, Homo sapiens
taggttaagcagggcaagacaagtcacagagacgagttaggaggcagggcaggagcccaggctgcagctaataagtaagtgagccaccgtcattgcgggggtagggaagaagagatggatttggaggttttggaggtgggttttataaggacttgttttctacagcaatcctttcttgggttttactttgctaggctaagcgggaagtacaaagatgaaattgaactttttccctcaaagagcacatctctttgtagataaaccatagtcaggaaagagtattttcagtatggttgataattccaagtaatgtgttagtgcctcatgttttccagacagacttccaaaagaggtcatgagtaaagttataaaaaagaaaaatgatttgacaaccttaccaaagaatttttacctgacacattgaattgccttattctttaattcaaaaaatatttatgaacctttaaaagccttaagttgctaacactctgtccagtgtccagtgtgaaagctcatttcacaccaatgagctttctgtgggcggtcagcactatggctgtattctccttttccttagtgatcctccctgcccacagtctgatttgagttagtcttgatttctttcagaacgtgggcctgtgaacttggctggttttcttagccagataaatagtggagcatggatggaggtatgtggcagaagggtcacagtggtgatcccccagcccaaaagtgaaaggcactcaggaggtgcttcactaccgggttccattagtggatttaatcacaggtgatccaaggctttcagaacactgggcaattcttcacaagctccttgagggcagaagtagtgtgttcctcacctaagtatccatgtgggctccacactctgctccccattctccccgcggccatatgcctcaaatggtgctgggacatgggagacactca

SEQ ID NO: 73867 - DNA, 298 bp, Homo sapiens
aattgctggataatatggcaattctattttaattatttgagaaagcttcacagtgtttctgtaatggttgtaccaatatttctgtatttttaagtgtatgttgtactctgttgggagccaatttttatagacctgttggttaatttgttttacatcttatataagcttccatttggacaatcttttcaaggatgtttttaaataactaacagccttgtgtgaagtgagtagtgtctctttttagagcagaggtcaaatacatacataaataatttaataaaattatgttttccccaga

SEQ ID NO: 73868 - DNA, 264 bp, Homo sapiens
gttagtggtagcctgggcctaggcgtggaagcaaggactgcctgcaaagaggtacaagatggatatcttttggggtggtggtaatattctaaaactggattgtggtgatagttatgcagcttcacaaatttaccaaaaacagctgaattgcatactctttttttttttttttgagacagagttttgctcttgttgcccaggctggaatgcaatggtgcgatcttggctcacggcaacctccgcctcctaggttcaagcgattct

SEQ ID NO: 73869 - DNA, 606 bp, Homo sapiens
gttagtggtagcctgggcctaggcgtggaagcaaggactgcctgcaaagaggtacaagatggatatcttttggggtggtggtaatattctaaaactggattgtggtgatagttatgcagcttcacaaatttaccaaaaacagctgaattgcatactctttttttttttttttgagacagagttttgctcttgttgcccaggctggaatggcaatcctcgtgcttcagctacccaagtacctgggactacaggcatgcaccacaatgcctggctaatttttgtatttttagtagagacagggtttcaccatgttgtccttgctggtctcgaactcctggcctcaagagatctgcctgccttggcctcccaaagtactgggattacaggcataagccactgcgcccagcctgaattgcatattctgaatgggtgacttttatggcacgtgtgtatatatacacacatacaggcggtggtggtgacaacttctgtaacctaatcacctctggacttcccactccatatgaaaccgcctggttcttaaagccgagaggcttcacgcttggatgtgcttatcactaggggggggggggggggggggaattc

SEQ ID NO: 73870 - DNA, 1176 bp, Homo sapiens
gagacagcagtgagcaaagctgacaaaaatccctgcagggcgaggcttctgttccagtggatgaatctgacagctttcctgaaaggcatactacatcctcctgagctagcatcttccagtttttgctttgcatatgatgatatgcaactcataaatattgcctgttatataacactactttcaagcataatgagaggaataagacatagggaatgcattatagtggagatagtggcattgcttttttgcaaggaaaagagaaaaagtgaccctgtggttctgtagtcccagggtgctgcgcatggctcagtgggctgtggcatagcacgccctgcaggggaggtgagggggagacccggcagcttcaggggcgggacccagcccttggcgatgtgacaggtcactctcatgcccagccttccttcttgtccataatggacatggagaggacttctgtgcttggtactctttaattctgagaagagaactctagctctctctctctaagctcagcagaaaggagtggtaaaagtggaggctcttctaacatacctgccgcaaattacactgcacctgttccttggcaaggtgcagcctgggattcaagttcaaggggctgcgaaacttctattactcatcactttagatatgaaagcattttaaatgttttttttaaatccattaaaaaaaaaaaacctctgttactaattgttagttgcttcttgcagggttatatcagttcctagcttgaggttttccagggactttaaaacctcagcaaagaatagttttaaggactcctcccccatttccattaaagcagatggagcataggcacagtgcaaacattccatatctcggtgagtaatgtggacttcgtaccctatgcaattttgttctttgtgtcttaatcataaaggaaccagcctaggtctcataaaaccacaaagggcctcttgatttgtaactgatacatggggaattaaacttttgccagaatgttaagtttaaggaagttattttaaaataagtgagttactgatgttaatagggtaataaaattttaaaagcttcagtctgtactatctttgtggttctgaatagaggatgaatcctatttttactgcttatttctgagaactttcagtaaaattatatttgatacagaatataaat

SEQ ID NO: 73871 - DNA, 263 bp, Homo sapiens
ttcctctccactctctagactctctttgtaccagcaagttaactgttgagcaattctttggtaattaaacaatcattacagcattattagctccacactctggatgacatctttaagcctctctcatgtgttaagcatgtctaatgtgtttttccacttttggataacttaagagaccaaaatataccacctcaaaatatgcctctttggcataagcattattttgagccaactatttttgagaaacagcagacaccggagaa

SEQ ID NO: 73872 - DNA, 175 bp, Homo sapiens
tacttggtacaataatttattattgtaaaaaaattaacatttattagctttaggaattttacatgtactgttgagttagtttgtcaaatctatataactcgtctaagatgaataatactgtatttttgtgactggccttttgcaatcagtatagaatcctgaattttttttcttt

SEQ ID NO: 73873 - DNA, 2200 bp, Homo sapiens
ccagagaggtaaaaacataccaggtgagcaaggggctcatagagaacagtgtttccaacaagtgttttaatggaggacttgtccaaattagacatcaattcatatgaggatggaaaattggttcttgattttatgacacagaggttgttgttggctttgatgaatgctattttggaagtaaatttaaacaaagcaattgagcaaactcagaggaatttctgaattcaggtggtgttacttcaccatgaagcaatttttctcatagaaaaatatcaagccattggactagattattctgtcgtttgggttatactgagaaataagagttggctaaagtagaaattacatgagatttggaaggtcaaagggaaggagcaactattgctgtgaaagtctttgaaattagagacagtgaaggacagatgcagaggtacccagcaggttccagtttttcctatcttccactctatatccagcccttctttccatcttccagccctgctgaccaacagtagccccaggtctaccaccagatgcttggctgcaggctcacaaaagcttctcatggacttctccaccagcttctcatggcagtcccacatcagcagctagatgtgcctggcttctcagattttcctgaaagctctgatttatccacccatgctaatgtctcaaaagggctggtttagtgatttctttagtcttctaactcccccttctaaaccttccccagctacctctataaattgtgcatgcatcccttattccataatgctcatagttattatgcttccctgattgacatatttatactttcttttcctgagaatttggtagatgctgctcttctaaaattgagtgatgttattaagaagtcttagacaaacttgctctcttttttcttgtatataatgtgcctttctgccatatgattctttttttattcttgaagttaaggatctatggaagcatatgctttggtcctgatctttgtgtattaattttacctgagttatagtgagccattccaatcattcatttcaaggaagttttattttgcttaacattttttctgatccatttcttctcttcttcagggacatcaattatgcatatgtaagatgtctttgtcaccttctacattcatcttctaccaatcaacatccatttcacatcattattcttttcagttttgtgtgattgactctagccttgtcttcagagacaattctccttgaatctcatgttcttcatgtttagacattaacaagcaatttgctcagatttatttacattccaggatagtaaagatagagaatgtctccctccctggagactttcccagagaagatttggttgcattccaggttaataaagattatatatatatatacccaaagaagaggatggacaataaaacaatataacattatttccctcacatcttaattatgtgtattttcaatcatgtagaaatattgaaaacacagtacaacctatataacatccatctagatttaacaatttatatgtaatttttcctgaaataccagtggtaagttatagatataacattataaccataaataattgagcattcatctcctaaaaataaggacattctcccacatacctggaatatcattatcaatctaattctatgatatatccagtccatttccaaatttctcccattgtccccaaacatattttacagttttaatgaggtagaattagcatacagaaagtggaacttgtttaaagtgtacaatttgatgagttttgacgtgtgcacctttccaaccatcatgacaatacaaataatgaacatatcaatcaccccaaaaaagtttccttatgcctctttgtcattcagccccctttccccacattcttcccacatccacaggcaatcatggatctgttttctattgttatagattagtttgcgtttcctacaattttatacacatggaataatactataggtactcttgtttggctccttccatccagcataataagtttgagattcattcatgttgttatatgcgtctatgttcattcctttttattgctaagtgttatttcattatatggacataccagaatttgtttatccattcatgttttgatggaaatttgtatttccagcttttggctattacaaataaaactgatgtgaacatttgtttacaag

SEQ ID NO: 73874 - DNA, 614 bp, Homo sapiens
aaccctaccctaatataaaacacgcgtagaagtggttggagctgcatgtcaggatcataatagtctgctagtgttttgtccaagctgaagttttacttcttcaagttttttgtagcacattttccttcgtttaaaatttaagacggtaaaattttttgaagaatttactgtcaagttgagctgcattagtatcataacttcagaatctactttgccagtacaggaaagctctacccgaaacactgataaagtgcgtggaacttccccctgaacagaaatgttgacctggggcatatccattgccaaaacattgtccacttggaatcccagcttatattcaaccttggacttcgcatgccaggtgaagtgcaggaaatttgtctcactgggtactaacagactaaaggatagagcgtagtgactaataaggtcatttctcacataataaagttctgcatcaagaccgatcagccggcgcacctcgtcctcgctcaggtagagactcacgctgggccccgcggaagccgactgcagctccgggggccgcggggcgggggcggcggcagccaggcgcgggcagcagcggtagcagcagcggcggcggcggggccttc

SEQ ID NO: 73875 - DNA, 259 bp, Homo sapiens
ggcaaggagagggtaagtttgtggcaggtggagtagtgggtacttaggacattctgatagtatatttagctcattctcctctttgagactaataatgacaacattcagaaaggttaaaaaatgactttcttaaggtcataaactataaagaggctcagattggcacttcaactaagataccttgaacttcaaaagcatgtcattatcattgtctgcaaatactgtttgagccttcagtgagagtatatttttaggttct

SEQ ID NO: 73876 - DNA, 2135 bp, Homo sapiens
ggccgggcgggggccgcggaagctgcgatgcggacagggcagcggcggtgacccgagctgccgcccgacatgaactcgctggagcaggcggaagccccgcgagttgtatccctgattcctgcggtggtttccggtaactgccaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttccgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtgattggact

SEQ ID NO: 73877 - DNA, 2010 bp, Homo sapiens
ggccgggcgggggccgcggaagctgcgatgcggacagggcagcggcggtgacccgagctgccgcccgacatgaactcgctggagcaggcggaagatctcaaggcttttgagaggagacttactgaatatattcattgtttgcaacctgctactggacgctggagaagtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttccgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtgattggact

SEQ ID NO: 73878 - DNA, 2084 bp, Homo sapiens
ggccgggcgggggccgcggaagctgcgatgcggacagggcagcggcggtgacccgagctgccgcccgacatgaactcgctggagcaggcggaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttccgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtgattggact

SEQ ID NO: 73879 - DNA, 378 bp, Homo sapiens
ggccgggcgggggccgcggaagctgcgatgcggacagggcagcggcggtgacccgagctgccgcccgacatgaactcgctggagcaggcggaagccccgcgagttgtatccctgattcctgcggtggtttccggtaactgccaagatctcaaggcttttgagaggagacttactgaatatattcattgtttgcaacctgctactggacgctggagaagcgccgtagctcacgcctgtaatcccagcactttaggaagcccaggcaggcggatcacctaaggtcagaagttcaagactagcgtggccaacacggtgaaacgccgtctctactaaaaatacgaaattagccggtcgtggtgacgctgcctgtgatcccag

SEQ ID NO: 73880 - DNA, 2331 bp, Homo sapiens
tctcagtacattcaaaaaggagtctttgatggtttgtttacagtagaaaatgagtttgtttttttaatttgagtttacaagatctgcaaaatcttcactaagcacagtgaacgttacatagcgtagactcttctactgaagtgtcaccatcgaattgctttttatttcattgatcatcataagttctgaccaaatcataagagaaacagtatccttaattactaaggttcacaatgtttaagagaattcctcgaagccagatggcaagccttctaattcctgagtctagttagtgcattttccatttaataaagtgctatattctttggttgtcatttagtaggaactggtggtgatagtatcacatattaagtatgtatttgcttactaatttcgtgtttatctttcatcagtgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttccgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtgattggact

SEQ ID NO: 73881 - DNA, 1057 bp, Homo sapiens
aaaaattaaaaaatataacaatgtattctgttggtgagacaggatatagtcggctgactgatgaccctgcaaaaagatatgtccatgtcctaatctctggaaactgtgaatgttacttaatttggaaagagggtctttgcagatgaaattaaattaagaagtttgagatgagtagttcatcctggattgtctgggtgggttgggtcctaaatccagtgacaagcaaccttaaaagagacacaaggagactggcagacagaggaagaagaggcagcaatgtgaccccggaggtggaaatctcagtgatggggccaggaatgtcaaggaatggtcaaggaatggctacagccaccagaaaaagaggcaaagtgaggcttctcccctagaatctctaggagcgctccagccctgctgatgtctagatttttggagttctggcctccagaatgtgagagagtaaactattgtttaaagctaccaagtttgtggtaacttgttagagcagccacaggaatgaatgtacagggaatcaggcagtctcatacactgatggtgggaaaacaaaccggcacaacccttatggtgggaaatttgacaacatgtacaaaaactacctacacatttcccttgtgacccagccattccactgttaggaatctgccctgaagatacaactccacctattaaaaaatacagccattagaatggatgatgtttaccgctacttgctgacaaagaaaaatgttcacttgtgttaaatgagaaagacaggtctcagaacagcaacaatgttctagacgattctgttttttaatactcagtatatgtagaggagattaaagggatttatcgtgagatgctcatagggggcaactgttatttcagatttcttttttaaaatttttaattgacaagtaataattgtatatatttgtacaacaattgtatgtattgtatgtacaattgtatattgatgtatatatttgtacaataattgtataatttatatggtacaatgtgatatttgtatgcatcaatacatgatggaatgatcaaa

SEQ ID NO: 73882 - DNA, 380 bp, Homo sapiens
ctaacggtttggaacaaatgcagtatagctcaaggagccctggtctcgggataaaaaggagttcaaggccagtttctgttacgggtctgagccaagccacatcacttctgtaaacaagcactggcctccagataaacagtattaaaacaattacaactcatccagctcacagatgctgattcactgaacccctgttccaccgaccagaaacagctttgactggacaagaggctgaattcagtaactttctcctgatgagaagaccaccagccatggactggttcttgctggtttacagagactgcacacctgtgtaccttcatgtcctgaaaagatcttttgacataggggctaggtataatacatttcatctattcatt

SEQ ID NO: 73883 - DNA, 1120 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacaacactccaacaggtacacgagctcgattcactgccgtcgtca

SEQ ID NO: 73884 - DNA, 372 bp, Homo sapiens
cttggggcttttgagttgcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcaggtaatatctgtgaagcagtttttatgcataaaaagttagtctgtcatttaccgtgttaaaaattaacaaagaatttcagcatttgaataatagttaacttgaaaatctacattaagtggatgattttctagcaaaatagaaattgcaaaaattataagtctaaacaagcatacttcctcc

SEQ ID NO: 73885 - DNA, 594 bp, Homo sapiens
agtagagacggggtttcactgtgttagccaggatggtcttgatctcctgacctcgtgatccgcctgcctcagcctcccaaagtgctgggattacaggcgtgagccaccactcccggcccgtcgtgagcttttaatagctccatgaagactactagactttctctaaaattagatttcccagtgcagtgcctcagcagtaaatattggtcatctaatgctacaatagggttaattgaggcaacaaagaagttaatatttttagaatgtttgcatgctattaattatagtcttagaatatcttgctatctttttttgtagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttgggtaacatcactctaatcctattatactacatgatgcctgtacactaccgtcctgta

SEQ ID NO: 73886 - DNA, 590 bp, Homo sapiens
agaaaagacattgaattctgcttttgcaaaattataaagggatctgggatcattttcataccttatgtaaagattaagcatgttttttaatgctttgttgaagaaattaatgtttattgtcttaattttaaacttgttctctagatgtgtttgaagatttcatttctcctaccactgctgcccagacacttttgtttacagcctgtagtaagaggaaagaggtaggcttatttaatgtttagataacttttctgtattatttaaaatttattcaactatacactttttaaatgttagtcatgtgagtcattttgttagtatgttttttaaggactgttggcctattcagtaacaatacttttctcttttaatctaggtactgcaaaagactatgggattttgttaccagattcttacagaaccaaatgctgaccctcgaaaaaaagatggagccctgcatatgattggctctttagctgaaatacttctgaaggtattctttagtgtgtttgtatgtgcatgactatgcaagtagttttaagggatgctgaggcaggcagattgcctgagcccaggagtttgagaacagc

SEQ ID NO: 73887 - DNA, 5873 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgt

SEQ ID NO: 73888 - DNA, 6151 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaa

SEQ ID NO: 73889 - DNA, 6176 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaaaaaaaaagtcgacgcggccgcgaat

SEQ ID NO: 73890 - DNA, 6096 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttgtgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaa

SEQ ID NO: 73891 - DNA, 6022 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagccccaggcagcaatgtgctattgaaacttctaaaactagg

SEQ ID NO: 73892 - DNA, 5271 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattccca

SEQ ID NO: 73893 - DNA, 4912 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggca

SEQ ID NO: 73894 - DNA, 5352 bp, Homo sapiens
  misc_feature (5295)..(5295): n is a, c, g, or t
  misc_feature (5335)..(5338): n is a, c, g, or t
  misc_feature (5341)..(5341): n is a, c, g, or t
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccaaaaaaaaaaaaaaaaaaaaaaaanaaaaaaaaaaaaaaaaaaacaaacaaataaaaaaaaaaannnnaancagaaaaaaaa

SEQ ID NO: 73895 - DNA, 5164 bp, Homo sapiens
  misc_feature (5107)..(5107): n is a, c, g, or t
  misc_feature (5147)..(5150): n is a, c, g, or t
  misc_feature (5153)..(5153): n is a, c, g, or t
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaaaaaaaaaaaaaaaaaaaaaaaaanaaaaaaaaaaaaaaaaaaacaaacaaataaaaaaaaaaannnnaancagaaaaaaaa

SEQ ID NO: 73896 - DNA, 5172 bp, Homo sapiens
agcaagactccatctcaaaaaaaaaaaggccagcattagtgaagcattcacatttttgtcaatctattctcatctcatgctgttcctcctatattgtattatctctatcattaaataagtgtctttttaaaggaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgt

SEQ ID NO: 73897 - DNA, 5073 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaattctacctaaatctgccaaacagaaaaatgtctacgttgtggtgaaccgttaccaagggttttttcccccgaaatcccgaagtgggccctgttccccgtgctaggggctcaatttaggcaaaaagaaggttttgtcatgtcgggggaaaaaaaaaaaacgctttatcccacaactataaagg

SEQ ID NO: 73898 - DNA, 2457 bp, Homo sapiens
aggagttacgatatcgtcgaccacgcgctcctattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgt

SEQ ID NO: 73899 - DNA, 2432 bp, Homo sapiens
cgagctcggtacccacctgagtcgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgt

SEQ ID NO: 73900 - DNA, 4278 bp, Homo sapiens
  misc_feature (4271)..(4271): n is a, c, g, or t
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggcaaaaaaaaaataaattangaaccca

SEQ ID NO: 73901 - DNA, 5652 bp, Homo sapiens
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtgggggggatgggaggtaccttagagggagtattttctttattttttgaagaaagtaagatcctgactctgaagcttcaaatgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaa

SEQ ID NO: 73902 - DNA, 2124 bp, Homo sapiens
aatggaatccaggagctggttttttgaaaggatcaacaaaattgatagaccactagcaagactaataaagaaaaaaagagagaagaatcagatagacactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacaccaactgtataccctaggttgcttaaagggatttcactattatataaagtcaataaaaatgaagtagttgtatatatgcaacattgtgtacagaggggaaataatgaatagtattaaagaaacattctcgtcttcctttacctttaatcccctaatacctagtctactttttaaattttcagacttcactgctttttgaattcataattctaattttcacattattgttaatggaaaatcatatctaataaaggttttagttattcccatgcacagtatgaaaattctcatttgctgaggttttgtttcaagaaaatgtattggcatgtctttgagaacatgttttattgtctcctgtgtcatataatccaaactaatctccgtttacagactttaacttgaaattagaccttataattaaactatttaaatagtgttcaaatgatagtttctaatgcatcaaatatatacctcagttttcatgatttcctttaacattataatttggtatagatcaagaatcttaacatgtatcagtttctagatgaggctgcaggatttttggaaaactttttgaatgtatttacaatattctcttgtaattagctacatagggacttgtctttttttctttttacatacagcttttcctacagttttattaccctgtaatttttttttagttgtagaagttaattctgattttgtgtggatttcagtatttgtctttgttaatggcacatattagcataaatcacttttgtaaatgtaagctttctttttttttcttgaaaaagcctttctatttatcagtattaaataaaggaagttaatctgtttctctgcaggtaataaaatagtgacacactgtattaagatagtgactgctatactcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaa

SEQ ID NO: 73903 - DNA, 3567 bp, Homo sapiens
  misc_feature (3431)..(3431): n is a, c, g, or t
cgcgccggttgccgctgcggagcgcggcgggtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagcgccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtataaaaaaccagaggagcggagtccattggtagcagcaatgcagcattttctgccagttctaaaggatcgttttatccagcttctttctgaccagtctgatcagtctgtcctcatccagaaacagatattcaagatcttctatgctcttgttcagtatacactaccactggaactgataaaccaacagaacctgacagaatggatagaaattttaaagactgttgtgaacagggatgtacctaatgaaacacttcaagttgaagaagatgatcgacctgagttaccatggtggaaatgcaagaagtgggccttacatattttagcaagactttttgaaagatatggaagccctggcaatgtttccaaggagtataatgaatttgctgaagtatttctgaaggcatttgctgttggtgtccagcaagttttattgaaggtgttatatcagtacaaggagaagcaatatatggctcctcgagttttacaacagacattaaattatattaatcaaggagtttctcatgctctcacctggaagaatctgaagccccatatacaaggcattatccaagatgttatttttccattgatgtgctatacagatgctgatgaggaactttggcaagaagacccttacgaatatatacgcatgaagtttgatgtgtttgaagatttcatttctcctaccactgctgcccagacacttttgtttacagcctgtagtaagaggaaagaggtactgcaaaagactatgggattttgttaccagattcttacagaaccaaatgctgaccctcgaaaaaaagatggagccctgcatatgattggctctttagctgaaatacttctgaagaaaaagatctataaagatcagatggaatacatgttgcagaatcatgtattccctctcttcagcagtgaactaggctacatgagagcaagggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggcaatgacatttaaccaagtaatccagacggggccagatgaagaaggtagtgatgacaaagcagttactgctatgggaattctgaatacaattgatacacttcttagtgtagttgaagatcataaagagataacccaacagcttgagggaatctgcttacaggtcattggtactgttttacaacagcatgtcttagaattctatgaggagatcttctctttagcgcacagtttgacatgtcaacaagtgtctccacagatgtggcagctactaccccttgtatttgaagtctttcagcaagatggctttgattactttacagatatgatgcccctccttcataattatgtaacagttgatacagacacacttctgtctgacaccaagtatcttgaaatgatatacagtatgtgcaaaaaggttcttacaggagttgcaggagaagatgcagagtgtcatgcagcaaaattgttagaggtcatcattctgcagtgcaaagggcgtggcattgaccagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccgaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaactattcaaaatcgtaatcctgtgtggtatcaggcactgactcacggtcttaatgaagaacaaagaaaacagttacaggacatagcaactctggctgatcaaagaagagcagcccatgaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtggggggtactatnactgattggcctactgctgcaacatcactcagggtgaacatattcaagttcctttgaaagcgaaaaaagtgcctccccggggggaaacatactgggtttagatgatggggaagaactgtttcctaagggattagaa

SEQ ID NO: 73904 - DNA, 344 bp, Homo sapiens
agaatttcagtattgcctcgggatggagtaggaggaatagtgtagaacggagctaccaagcctctcttattcatgttgtttttcccttgtttttattttttgatagctattcaaaatcgtaatcctgtgtggtatcaggcactgactcacggtcttaatgaagaacaaagaaaacagttacaggacatagcaactctggctgatcaaagaagagcagcccatggtatgttaattaactgtaactcctctttaattagtgacttttataggtttaaaattttatatcgtttaattttatatcattaaattttatcatttaagatgatataaaaggtatagttgtt

SEQ ID NO: 73905 - DNA, 331 bp, Homo sapiens
ctcaactctggaagagactagagtatagagcatgagtggcaaaaccacagcccttgggccatatgctgctattcagtcccagatgtagcccctgaagcaagcataaagaaaaatgaattaaaaattaaattaatatggaaagttaaaaaatggattacattagtatgactaaaccatgtctttggcaaagatctaacacaatgtcttaagtataataggtagtctctgtttgtaaaataaatgacttaaatttaaaacatcagttataaaactgtcagttctgttctttgtaatttaaattttggtaaagattttctgtgaccgtttatca

SEQ ID NO: 73906 - DNA, 572 bp, Homo sapiens
caaatgagatttttcctaatgagtcacagactatagcctacctaatctttctctcgccactatactgccagcaccaaatatagtgtctggctcattgttgaggcactcggtaaacatttggtgaatgaaagaatctcatgctcaactaattttactgttttgtggaaaagactcatttccaatgcaggattttatctgtctttaaaatatattcaataaagttccaccccccactttttttttttctttgagacagggtcttgctgtgcagtgattcaatcgtggctcactgccgccatgacctcttgggctcaatcagtcctcccacttcagtctccaaagtagctgggactacaagcatgcgccactatgcctagctaattttttttttaactttttgcagagatggggtttcaccatcttgcttaggctagacttgaactcttgagctcaagcaatctgcctgccttggcctcccaaattgctagggttacaggcgtgagccacactgtacctggcccaagttttgttttcaatatccaagttattttctttcataaaagaatgagaaa

SEQ ID NO: 73907 - DNA, 411 bp, Homo sapiens
actttgggggtgtcatttaacctctccagcttttgttgcctagtcataaaatagtgacaacaatagggccagctatatctattttataggcttttataagcatccactgagatcacaggataccatggggaggagggaagtgtagcacagagttatttagacttttcctattgatacccacgatgttcataagcaacccactcccatagtatcactggagtcatgtagcaagacaattccctgcaggctagtactctccagcacatccctttctttcctactcaaaaaaacatcctgggatgcagaagagtaaggagcattttatgataggatatgctcttgtttctttccaaagagaaaatgttgtaaaatttgttactagtaataaattgataacgatatgctctataa

SEQ ID NO: 73908 - DNA, 7896 bp, Homo sapiens
  misc_feature (7434)..(7434): n is a, c, g, or t
atgcagtccggccgcggccccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactggtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcatagtacaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagctcgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccttgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacaactagtccgggctggtcagccagccacagccttctcccagcaggacctgctggatggggccgttctctatagccacaatggcagcctcagccccgaagacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggacccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttcccgttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaaggcctggcctgggcccagatgctgatcgggccagggacaggcttgcccatgtcccgggccccattgcttccatgcccggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttctactccaacccaggccaccctttgtctctnccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgtagtgccagtgcccccctgaggactagggcaggcagctgggggcacttggttccatggagcctggataaacagtgctttggaggctctgg

SEQ ID NO: 73909 - DNA, 940 bp, Homo sapiens
cccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccactgcaagctttcttcctggtggcagatgacatcatggattcatcccttacccgccggggacagatctgtggtatcagaagccgggcgtgggtttggatgccatcaaatgatgctaacctccttggaagcatgtatctacccgctgctgaagctctattggcgggagcaggcctattaactgaaactgatcgagctcttctgcagagttcctatcagactgagatgggcagaccg

SEQ ID NO: 73910 - DNA, 1032 bp, Homo sapiens
tgacgttagacagagtcttgcaccgttgccgaggctggagtgcagtggcacaatcttggctcactgaaccctctgcctcctgggttcaagcaattctcctgcctcagcctccggagtagctggggttacaggcgcacaccaccatgcctggctaattttttgtatttttagtagagacgggggtttcactatgttggccaggctggtctggaactcctgacctagtaaaaccccgccagcctcagcctcccaaagtgctgggattacaggtgtgagccacaccgcaccgcgactcaaagagcttttttaaaaatatatttagcctgtccctcagcaattctgattcaggaagcgagagagcaaagcttggaaatctgcattttcacactgccctggttgctgctggtgaaccatcagcatcatggacgagtatcttcctctacagacagtcaggctgaagtcagggacataagataacctgtcaccaagtccctaatctcctgcccagtcatcatcgtttaaatgtgtaaccaaaaagagccattaaaaaaacaaggaacttttttccatactcttctcttagtctgtaagatgagatagtctttcacagtccttgctggagtttagcggttttattggtggtcattgttaatcaaggagtaaaaacacaggttttgattctttgcattctaagtgtttttttggttttgattgtagtggttgaaaaatacgattatgtgtttccagaaaatggcttggtagcatacaaagatgggaaactcttgtgtagacaggtaggttcttgagtatctgaattactatatactattaaaagtgttttctaaaagggcatttcacaatgaatgcctctaggaagatgaggaacgggtagaaatgaatctttactctgtattttttgttttgcattttgaaccatgtgactattacatattctacattgataactaaatttttatactttttaaatctaatatttctctcttttcttattttgtttttgagacggagtct

SEQ ID NO: 73911 - DNA, 2780 bp, Homo sapiens
tgacgttagacagagtcttgcaccgttgccgaggctggagtgcagtggcacaatcttggctcactgaaccctctgcctcctgggttcaagcaattctcctgcctcagcctccggagtagctggggttacaggcgcacaccaccatgcctggctaattttttgtatttttagtagagacgggggtttcactatgttggccaggctggtctggaactcctgacctagtaaaaccccgccagcctcagcctcccaaagtgctgggattacaggtgtgagccacaccgcaccgcgactcaaagagcttttttaaaaatatatttagcctgtccctcagcaattctgattcaggaagcgagagagcaaagcttggaaatctgcattttcacactgccctggttgctgctggtgaaccatcagcatcatggacgagtatcttcctctacagacagtcaggctgaagtcagggacataagataacctgtcaccaagtccctaatctcctgcccagtcatcatcgtttaaatgtgtaaccaaaaagagccattaaaaaaacaaggaacttttttccatactcttctcttagtctgtaagatgagatagtctttcacagtccttgctggagtttagcggttttattggtggtcattgttaatcaaggagtaaaaacacaggttttgattctttgcattctaagtgtttttttggttttgattgtagtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73912 - DNA, 2204 bp, Homo sapiens
tcgccatgttgtccaggctcaaaatatgagcattttaacacaaagtcaatatacaacatgattgatgcaattacattcctttttcatactaaatctttcaaatctaatctcaattcatattagccacatttcaagtcttaatagtcacagtagttcatggctaccatattacatagcacagagctgagaaacattgaccacactagcctctgctttttagaatttcccaagattttaggctgtttatctatgatgttgcccaaatgaataacgtgtttttggagaaactctgtcaccctttcattcccaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73913 - DNA, 2231 bp, Homo sapiens
cccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73914 - DNA, 2139 bp, Homo sapiens
cccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73915 - DNA, 2022 bp, Homo sapiens
  misc_feature (27)..(27): n is a, c, g, or t
aacttatggctaggtcaggctggtgtnatcggccgagggaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73916 - DNA, 963 bp, Homo sapiens
taaggatcccggccgcggactatgtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73917 - DNA, 2308 bp, Homo sapiens
cccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73918 - DNA, 2291 bp, Homo sapiens
  misc_feature (27)..(27): n is a, c, g, or t
aacttatggctaggtcaggctggtgtnatcggccgagggaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73919 - DNA, 2131 bp, Homo sapiens
cccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaatattcaaagtcatctgggtgaggccctaatccaagatttaatcaactactgtctgagctacattgcgaaaattaaactcccgaagaagagaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73920 - DNA, 2208 bp, Homo sapiens
cccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagagaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73921 - DNA, 1785 bp, Homo sapiens
gagcacgtgtgtttttatgagaattatgccgagataggtaacagatgaggatgaaatttgagctttggagggggatacctgatatcctttggagagtaaatgctgaaggagcagaagtgtgtcttgttgagaagattcaaaggaggggctacaaagaagaaggtcatcaatatattaaataagggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagcccactagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttcccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtt

SEQ ID NO: 73922 - DNA, 286 bp, Homo sapiens
gtatttttagtagagacggggtttcaccgtgttagccaggatggtctcgatctcctgaccttgtgatctgcctgcctcggcctcccaaagtgctgggattacagatttgagtcaccttgcccggccagaaaactttaaactccatttatcttctttcaacttttgtgtgattgctgtcatatattttaaatcaatacatattttaaacccatagatattataattatggtttgaaacagtcctgaatgtgcatggattcatgcacattttctgttttagtggttct

SEQ ID NO: 73923 - DNA, 703 bp, Homo sapiens
  misc_feature (676)..(676): n is a, c, g, or t
atttctgtcatttcagccagctcagcctggttaagaacccttattaaagaactgatgtggtcattttaagacatgtgacactctggtcatttgaattactggagttcttgcattggttctttcttttctctgtgtgcctttgggagcctcttcccagggaaactctgtgtcactaacagtgggtatgctcagccatggctggggtgactgttctgcattcatgagccatgggccctgcctagtgaagagtaggggcaggggttcctagggaggagaggctgcactcctgtctgtatggtggctgtagtgtgctaaaaaagtcctttaactgcagtgtagtttgagtaattaatagacttccattctggatggtttcataggactcaagctttgtgcaaggtctttatttgttgctgacttcttttgtttgatttcatggggatgggtatgttagcgatatggtttggctctgtgtccccacccaaatctcaccttgaattgtaatccccataatccccacgtgtcaagggtgggaccaggtggaggtaattggatcataggggtggttttccccatgctgttctcgtgatagtgagtgagtctcatgagacctaatggttttataggtgtccagcatttcccctgctggcactcactctgtcctgccactctgtgnagaaggtgcctgtttctcctttgcctt

SEQ ID NO: 73924 - DNA, 374 bp, Homo sapiens
aaatattagtgacatcattgtctgcagtttaaccctagaagagtagtatctaaggacacagagtacttgccagctacttgaatgcattatttcagctgatgtgatttatattttgaaatatgagccagactgatggaattgactgacctatcttacagctataggactgtaattgagatcaagttctgttaagtttctgaaggcatgggtatgcggtttgctcaagagcattttttcacatttgtgttaggatagtaaattaccttgaaaactggaaacacattttaacaacattaaattggatttattcatttagtgtagatactgtagttcctaggtttgtaaactgtggcaagatgagttatatactgaaa

SEQ ID NO: 73925 - DNA, 425 bp, Homo sapiens
accatagcatgatctccacattaaacaactaattatcctaagaaaaattaacttggcaaggtagcatccactgttggttattaactaatattaataattgtcacattcatttaaaatgttggcacaagattcagtctccttctctatcccaagtaattccatgagtctggcttcagggagcatataagatattcaaccaacaacctagccttacagttctctgacctccttaaaaaataaataaatcaccaatgacctttagctccatttcactttgacacacaagctcccagggccacatcctgaactttatcatccatcacctagaagtgcttcatttctgaaataaaattcaaatgtctcatcctatgataacagtcttttactccgccagtcaccttccctttcttgcactccacctattt

SEQ ID NO: 73926 - DNA, 737 bp, Homo sapiens
agaaggggtagatgctggtgcgtggtctcagaccagtggaacaacctggaatgcatgttagaaatgcagattctccttcctcagtgcagactcattattcagaatctttgggggtcacacagtagaatctgcattgcaaacaggaactgtgatgtttcatatacactgtaaatgagaacctactgctgtggaagtgggaaaaccatttaggtagctgttaaagtagtcttatcttggtgagtggtgatgagatgaatttgagatatattttggaggaaggattagcaggaaatggggacaggtaggtatggctaaagaggattgaaaggtgtttacagtttgggtgacatatgacatacacatgcatatataatttttaaaaatagttgtgcttatacctgtagcctatgcttatttttataccttgatttgtcctcataacatattgaacaggcattttaaaatttaaacaacattctgtgtggaaaaaaatggaaatgggcttttattttcccttctaatgatccctctttttttaaagttagaaaagttttatcttccaagataaatggatagtcaacagttgcctattaacgttgatactagtatttcttcagagttgtacagaaaatgaattcttttggaagaaagaagaattccattttgagagttgaagaatgtgtttatttgttgggtttttgttggtgggtttgtggtatggttggactagtcggtat

SEQ ID NO: 73927 - DNA, 651 bp, Homo sapiens
atccagaggattcccgactagtccaaccatacacagtagaatctgcattgcaaacaggaactgtgatgtttcatatacactgtaaatgagaacctactgctgtggaagtgggaaaaccatttaggtagctgttaaagtagtcttatcttggtgagtggtgatgagatgaatttgagatatattttggaggaaggattagcaggaaatggggacaggtaggtatggctaaagaggattgaaaggtgtttacagtttgggtgacatatgacatacacatgcatatataatttttaaaaatagttgtgcttatacctgtagcctatgcttatttttataccttgatttgtcctcataacatattgaacaggcattttaaaatttaaacaacattctgtgtggaaaaaaatggaaatgggcttttattttcccttctaatgatccctctttttttaaagttagaaaagttttatcttccaagataaatggatagtcaacagttgcctattaacgttgatactagtatttcttcagagttgtacagaaaatgaattcttttggaagaaagaagaattccattttgagagttgaagaatgtgtttatttgttgggtttttgttggtgggtttgtggtatggttggactagtcggtat

SEQ ID NO: 73928 - DNA, 231 bp, Homo sapiens
ttaaagcaggcaagtagacattacaattctatgttaaaataagaagtgggatgttaatttaagagttgatctggtgaagactataactgcttgttcaaggatatgttaaaagattatcttgaagctttgacaagttcatattatagcatttgatggatcctatatacaaaggacttggaaatagccttcctaccctatattgggggatatatgtaatacgggacattttct

SEQ ID NO: 73929 - DNA, 322 bp, Homo sapiens
ggaggtgtgcccaggtctcagctgaggagggaagggatgcctgtaggagctgtggtcgtccataagatgttgtgggcagcagataccactcacaggcagagggcagaccctgccgtgtggctggaccacggatctgggggctcctgagcctggaggcagactcagtcgaggtaaaggctcaatggccacagccgaaatgtccccacccagctgggcctcagcatcatctatcaaggactggagagtcccccagcagtggacataccagggccaccactgatgaatgtccaaacctgttcagattttaaacttttttctttta

SEQ ID NO: 73930 - DNA, 356 bp, Homo sapiens
ggtgggaactgcagcactaggtgatgttgaagtctgagtgatgatggcacattaggtgagcccagaggtgctgtgaggagtgtagaataaggccgctgctttggagtgcagtctggggtcaaactaaaaggcataccttggagaaaccatgggtttgcttctagaccattgcaatacagcaaatactgcaataaagcaagtcccatgaaatgtttggtttccaagtgcatataaaatgcttttataggctgtaatgtagtctactaagtatgcagtagcattatgtctaaaaaagccaatgtatgtaccttaattttaaaatactttgttgctaaaaaatgctaatgatcatctga

SEQ ID NO: 73931 - DNA, 926 bp, Homo sapiens
aataacaccagctgattctgtgctaaacattctctcagatggtccccacgctaagtactgttagtcttttcgaaccagtaagtcaatttagaaaggctagctaatttgtctaaggtctccttggctggtaagtgactagcatactttaaaactgaggtttgtcagactggaagtcctttcctttacacactgagctgtgtgctttcctgagcttacttctctattccttttttccctcacatcattccacttcactctttaaccaccagctatttgtaattccttcttctaaggcatagtgaaaacttgctgcctgtctaaaaatgctttaagggaaacaaacattaaaaaaaaaaagtatttctgacagttttttggaacactttgataaaggatattaaacattttagcatccccaggatacaagaagataaaagaatgaggcacaggcaaagtaaaggtagttttccttatgcacatagttttgagtttcatagctgttgaattcctcacgtttaataaaagcttgagaccaagctgtgtagtgggaagattaggcaaagtgcaaaagcactttaagctatttgaaatgctaacaactccttaaataactgttggcttggaccttgtgctcattctgcatccgggtgtataaagcacctgcctgtgaacaaaagtcaaataacttactgagtaacttatacatagggtagagaggctacatagattattttgcatcaaatattctatcatcaaaaaagttaaataatgcagacaacattacttacaaataaaattgacgtgaacagaaaaatagttgatttggaatcattttcatttaaaatattttctctttgtcctctgtgccattccccctctaacatattttaaagcaaaaggacctctattggaccaaaaaaagaaaa

SEQ ID NO: 73932 - DNA, 919 bp, Homo sapiens
agagagagagagagagagagagagagagagagagagagatcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73933 - DNA, 3683 bp, Homo sapiens
gaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73934 - DNA, 3629 bp, Homo sapiens
gaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacgagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73935 - DNA, 1955 bp, Homo sapiens
caacatgtatgcagggacagaggctatggtccctacagagcaggcatggagagaaggagaaatacatacgggcaggagccaggagagggagggtgtagtgagcagagaccgcgccactgcactccagcctgagtgacagagtgagaatccatctaaaaaaaattgcttgctaaagaagtggtctcctgaggtcttaagacgttcctgacaatgtcttgagtgggtgggagagaggctgcagtcattgtgctgtggaatttcagaggtgagaaccacacctaaccaaaattactttccctgtttgcctcagtgacacagctgcaggaaccctggtgggtgttgtattaagtaaatttgacctttattctttgcagatctgtgaaatgttgtcttctgaggggccacgtgtatctgtagtgctgaggactccttgggcctctgaagtcacagagagaaccctgcagggtgggggaccagtgtgtgacagccctgctttgcattttctttgagaagtgctgtcattttgcatttctctccaccagggcaatcttcaatcttgagaggtgtgatcataacttgccttgtttcttgtcgctacagagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73936 - DNA, 3660 bp, Homo sapiens
gaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73937 - DNA, 1407 bp, Homo sapiens
ccgacacacaaacggccgacacggaaactcgttgaccctcgaaaacccaccaagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73938 - DNA, 3735 bp, Homo sapiens
gaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgttgaactgggttatttgcgttgctcactgccatgtcatcctttgttttgtagatgccgtggaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacaccgttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaatgtgtatgtttcttactaatttttaaaaatgtattccttgccagggcaggcaaggtggctcacgcctgtaatcccagcacttcaggaggctgaggtgggcggatcacctgaggtcaggagtttgagaccagcctgatgaaaccctgtctctactaaaaatacaagaattagccgggcgtggtggcgcatgcctgtagtatcagctactcaagaggctgaggtgagattatcgcttgaacccaggaaacggaggttgtagtgagcggagatcgcgccactgcactccagcctgagtgacagagtgagaatccatctcaaaaaaagacaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73939 - DNA, 319 bp, Homo sapiens
gacgaggcatgcgtagcgtgagcagagttcgccttcctctggatcgagaatgtgatctggaccgtgacctatttttcacgttagagaaaaaacaaaattgcttgctaaagaagtggtctcctgaggtcttaagacattcctgacagtgtcttgagtgggtgggagagaggttgctgtcattgcgctgtggaatttcacagatgagaaccacgcctagccaaaatcacttttcctgtttgcctcagtgacacagctgcagggaccctcgtggatgttgtattaaataaatttgacctttactctttgcaaaaaaaaaaaa

SEQ ID NO: 73940 - DNA, 2508 bp, Homo sapiens
gaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgttgaactgggttatttgcgttgctcactgccatgtcatcctttgttttgtagatgccgtggaaagcagatactctgtaagtacacatttcatatacattatatttaaaagtactccactgaacagtgaaatatttccagactcacccacgtcctgcattcacatgaattcttccccgctccctagtctgtttcagaccagaag

SEQ ID NO: 73941 - DNA, 482 bp, Homo sapiens
tcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaa

SEQ ID NO: 73942 - DNA, 355 bp, Homo sapiens
taaaaagctgcctctggttgccacttctcaaatatattcacatattaatattttaagggttcaaagacagtgccaatcttctcaatgacattctataatttaattaaatatctcatttatgtgtaagaaaatactttttttgatttctttttctttccttttcttttctttctttctttcttttcttttcttttctttttttttttgagatagagtctcactctgttgcccaggctggagttcagtagtatgatcatggcacactgcagccttaaacctcccaggcttaagctatccttctgcctcagcctcctgagcagctgggactacaggcatgcattaccatgcctggcta

SEQ ID NO: 73943 - DNA, 362 bp, Homo sapiens
ctggcagaagtgagcaaaacagctcaatccagcaggctccatgttagcagtaagcaactctaatttcatatctgactgaaaaaagaaaagaagcctatttatgctctcaacataataaagcagcctttgttttatgctaaggccctggtgattttttcagcaccagtccagctgtgacacacagacgctggttcgatgcctgcataaatgctttctctttgtttagtggtgagaacgtgagacctcactaaggcccaagtcctgggttctcctgatgtcaaccccacaagtgagtagtggagcctcactggcaaggagacctacctgtgcctttcccaaatgcctgggaaggtaggttagag

SEQ ID NO: 73944 - DNA, 290 bp, Homo sapiens
ctcatttctataaaaaagaaaataaggaactgattcaccatgcatatacacataaatgtatgtaatacacagatgggattgaaaaggctgtaaccaaggctgggcacgatggttcacgcctgtaatcccagcactttgggaggctaaggcaagtggatcacttgaggccaggagttcaagaccagactgggcaacatggtgaaaacccacctgtactaaaaatacaaaaattagcccggtgtggtggcacatacctgtagttccagctacttgggaggctgaggcatgag

SEQ ID NO: 73945 - DNA, 329 bp, Homo sapiens
gtgatctgcctgcctcagcctcccaaagtgctaggattacagtgagccactgggccctgcctccccagggtttcttaatgccttggtgaagaaagtgctctctgcacctcttagtcgtatggtttagaggtagctgagcacgttgcaaataaggaagttgctcagttcttttgagccacccaaatacaacaatcctttcgagccttcagactagggtaaccaactgtcctggtttacctggaactgaggagtttcccaggatgcaggactctcagttttataaccagggacatttcaggcacactggctcgagtcagctacctcacttc

SEQ ID NO: 73946 - DNA, 394 bp, Homo sapiens
tgatgtacatttagaccatgggatgtgcctcacctccaagggcctgccctgcagctcttaggaaggtgggcagtctcatcacagcccaaagtgagatgtctccaagcaaagagtaaatggcagcctctcttcagcctagactcttaaatagcacagtattctcccacttcctcaaacaactcgatggtaggtttctttcaacataaagagtgggagcactactttgagacactgataaacaactttcaaatagaaaataaatttcaaagtgaatgtgttttcagggcaaaattggtactgtctcatttcaaactatgaaaatatgatctgatttaatgagttggagtcatccattcatccagcacctactatgtgctaggtactgtgtaatgtc

SEQ ID NO: 73947 - DNA, 493 bp, Homo sapiens
actaattgaatgaaaacatgtaaacattagcatagatctaagaagactctgatctttaaaatatatctagctcttttctttacatgtattcaggatgacacttaaacctatgaacagtcatctctgttctctttccccctttagatcagactaaaggcctgtcaagagcagttgaagaactttaaagagtggttagtggggagaattaatgtcaaaatgaccacagcccagcttttaccttggaatctctgctagttcctgtgtcattctcattcccgtaactctcactcctaacccacctttttgttttccttttctatttccttttcacaaaccaactttgtttctttctctcatttagctataataaggtgatttaaaatttttaacgaataaagttgtatcctcatttattttaaaaagtttaagagttaaatttctatttactttctccataactttctcccatcccaactctccctttctttccaaa

SEQ ID NO: 73948 - DNA, 451 bp, Homo sapiens
tgagacagactctcactctgtcactcaggctgaatgcagtggcgcaatctcagctcactgcaacctccacctcatgggttcaagggattctggtgcctcagcctcccaagtagctggaattacaggcatgtaccatcacacccagctaattttttatatttttagtagagatagggtttcgctatgttggccaggctggtcttgaactcgtcctcaagtgaaccacctgcctcagcctcccaaagtgctgggattacaggcgtgagccactgcgcctgcaaaagtcctaattttactaaatctaaactcaagtacatgccattctactcttctgtgtgctgacgtgggaagtgtgcacaatgcctgttgctgcaaacccaactctctgtgaaaagcgctcgtctctaagctgccagctgcactagccactttttcacctgaaccactatta

SEQ ID NO: 73949 - DNA, 563 bp, Homo sapiens
taaagatgtattactttattttttgttgaagtataattcacataacagaaaatttatatttttaaagtgtacaattcagtatttttggtgcattcactgtgttgtacaataatctccacaatttaatttcagaacatttccattactccaaaaagaaattccatatatatatatgcataattagtcacaatttctctcttccctcatcttctggcaaccctcaaatcaactttctacatgtatttgcgtattctggaaacttcacataaatggaataatacattatgtggctttttgtgtctggtttctttcacttaccgtaatgttttcaagtttcattcatgttgcaccatgtaacatacctcatttgtttttatggctgaatagtttcttttattaaatgtatatatcacattttgtttatccattcatcattgatagacatgtgagttgtttcaactttgggctactataaataatgctgttacgaactttcatgtacaagattttgtggaaacatttcttttcaattctcttgggtatttaccagtgagtggaattgc

SEQ ID NO: 73950 - DNA, 436 bp, Homo sapiens
  misc_feature (430)..(430): n is a, c, g, or t
cataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctnaaattt

SEQ ID NO: 73951 - DNA, 213 bp, Homo sapiens
tcacttacccagctcatcattttctccctctccaaagaataactttattcagtggtcataaaatatttaataaaacatgaaacttaagtcactgtgttcaatttgccatcacagccatctcagtggcagacccccttcccccagctggcccaccccctcctgaagccccttgcctgccctccacagcagccccagctgttgatttatcagggc

SEQ ID NO: 73952 - DNA, 296 bp, Homo sapiens
tttgggtcatgtgctgattttaataggaagcttctagtagaaagctagaaaaaccggccgggcgcggtggctcacgcctgtacttccagcactttgggaggccgaggcgggcggatcacgaggtcaggagatggagaccatcctggctaacacggtgaaaccccatctctactaaaaatacaaaaaatttagccgggcgtggtggcgggtgcctgtagtcccagctactcgggaggctgaggcaggagaatgacgcgaacccaggagccggagcctgcagtgagccaggaccatgc

SEQ ID NO: 73953 - DNA, 877 bp, Homo sapiens
gcgtccgcgttcagcggacacgggagcaagatggcgattccgggcaggcagaatattgttctgagaagccacagaaaaagggtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctgtttaaggcagaaaatcaggggtttccatgagtagtccaacagataccaagagatgttctcaatggtgagtggaaccgatggaagggatgagtaaagggggggaaaaaattgaggaggaaggtagacttagtttgcaggtaaatggcttgaaggggggcaaggatggtaaagagacaaaaaaatgggagggagat

SEQ ID NO: 73954 - DNA, 767 bp, Homo sapiens
gcgtccgcgttcagcggacacgggagcaagatggcgattccgggcaggcagtatgggcttattttgccaaagaaaacacagcagttgcaccctgttttgcaaaaaccatcagtgtttgggaatgattctgatgatgatgatgagtagagacggggcttcatcaggttggccacgctgatctcaaactcctgagctcaagtgatccagccgcctcagcctcccaaagcgctgggattacagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccaggtgaggagacgtgtatgaaatatt

SEQ ID NO: 73955 - DNA, 558 bp, Homo sapiens
agtttagtcatttaattataacagcttagaatgtaaatatagtcattattctttctcttctagatgaggaaattaaggtaccaaaagattacaaacaaacttgcccggagtaattagtaagtgtagagccagcattcatacccaggcagcctggctccagagtttatttgtatttcctatctaaaaatgtgattgtaatttttatgatatattttcaatttatgaaccattctcaaaaaacatagactttgttgtatctattggctggctcatatttttgaaacatgtttaatttttttttaagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaaagaaagaaagaaagaaagaaagaaagaaagaaagaaagaaagaaagaaaaaaagaaagaaa

SEQ ID NO: 73956 - DNA, 2633 bp, Homo sapiens
gcgtccgcgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttataaaaaaaaaaagaaaaaaaaaaaaaaaaaaaggggggggggggcataaaaatttccccgggggggccaccagtttggggggatacccaggtttttgtggcccaaagggggccccaaaaggggagccgaaaaaa

SEQ ID NO: 73957 - DNA, 3016 bp, Homo sapiens
  misc_feature (10)..(10): n is a, c, g, or t
  misc_feature (259)..(259): n is a, c, g, or t
  misc_feature (265)..(265): n is a, c, g, or t
cgagaagtcntgaggaacatagattcccctcccccgtacattttcccggatggaagcccgaagtttgagggagaaacttgtgaggaaataaaggaagttaggctgaggggcagagagcgagacttttctattttccaaaagctcggtctgaggcccctcagtcttgcttcctaacccgcgcttgagtttctccccgcttggatgctctcaggggcagtgtgaagagagacagttcctggcttccttagagggccttgtnctcctnggcagaagctcaagtcctgattcccgcccttccttctcgttttaggaatattgttctgagaagccacagaaaaagggtatgggcttattttgccaaagaaaacacagcagttgcaccctgttttgcaaaaaccatcagtgtttgggaatgattctgatgatgatgatgagtgtatatccagtactggtgtttaaaggaaagttattaaagttggaataagagtacctgaattggaatcttgctttgccattcaccagctgtttggtccttaaattctctcaggtttttggcatttaatcgtcatccttagtggtaattgttaaagtacctttatttagaaaattgagaatcacatgaccttcaaaagatcatcagtttttcctgactttttcagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73958 - DNA, 2623 bp, Homo sapiens
gcgtccgcgttcagcggacacgggagcaagatggcgattccgggcaggcagtatgggcttattttgccaaagaaaacacagcagttgcaccctgttttgcaaaaaccatcagtgtttgggaatgattctgatgatgatgatgagatggggtttcactcttgttgcccaggctggagtgcaatggtgcaatctcggctcaccgaacctccacctcctgggttcaagcgattttcctgcctcagcctcccaaatagctgcaattacagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73959 - DNA, 2665 bp, Homo sapiens
gcgtccgcgttcagcggacacgggagcaagatggcgattccgggcaggcagacaccttgcagtaaatccatcaggaacttgctgtttatcaagcacagaccctcatggaagttcattgagcaaacagatgagggctgccacctcaacctggctagactgctgctctgatgttaccttcagcactagatggggtttcactcttgttgcccaggctggagtgcaatggtgcaatctcggctcaccgaacctccacctcctgggttcaagcgattttcctgcctcagcctcccaaatagctgcaattacagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73960 - DNA, 1997 bp, Homo sapiens
tgagttagaggatcccgtctctccacgacggaggcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73961 - DNA, 1590 bp, Homo sapiens
ctctagaggctcccccaataagaacaccctgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73962 - DNA, 2501 bp, Homo sapiens
gcgtccgcgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73963 - DNA, 2532 bp, Homo sapiens
gcgtccgcgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttatacattttatttatgcatttattttaaaataat

SEQ ID NO: 73964 - DNA, 2701 bp, Homo sapiens
  misc_feature (10)..(10): n is a, c, g, or t
  misc_feature (259)..(259): n is a, c, g, or t
  misc_feature (265)..(265): n is a, c, g, or t
cgagaagtcntgaggaacatagattcccctcccccgtacattttcccggatggaagcccgaagtttgagggagaaacttgtgaggaaataaaggaagttaggctgaggggcagagagcgagacttttctattttccaaaagctcggtctgaggcccctcagtcttgcttcctaacccgcgcttgagtttctccccgcttggatgctctcaggggcagtgtgaagagagacagttcctggcttccttagagggccttgtnctcctnggcagaagctcaagtcctgattcccgcccttccttctcgttttaggaatattgttctgagaagccacagaaaaagggagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73965 - DNA, 2532 bp, Homo sapiens
gcgtccgcgttcagcggacacgggagcaagatggcgattccgggcaggcagaatattgttctgagaagccacagaaaaagggtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73966 - DNA, 2169 bp, Homo sapiens
atgcagacagtgacttcgatgctaagagcagtgcggatgatgtaatagaagaaactagagtgaactgcagaagggaaaaggtcatagagacccctgagaatgacttcaagcaccacaggagtcgtaaccactctcgttcacctagtgtagaaagagggcaacagtacggcaagaagaaagagaaaagagggctgccgtactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73967 - DNA, 2034 bp, Homo sapiens
gcagtgagccgagatcgtgccactgcactccagcctggtaacagagtgacactccgtctcaaaaaaaaaaccatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcctgtagtcccagctgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73968 - DNA, 1949 bp, Homo sapiens
gcgtccgcgttcagcggacacgggagcaagatggcgattccgggcaggcagtatgggcttattttgccaaagaaaacacagcagttgcaccctgttttgcaaaaaccatcagtgtttgggaatgattctgatgatgatgatgagacctctgtgagtgaaagccttcagagggaagctgctaagaagcaggccatgaaacagaccaaactggaaatccagaaggcccttgcagaagatgctactgtgtatgaatatgacagtatttatgatgaaatgcagaaaaaaaaggaggaaaataatcccaaattgcttttggggaaagacagaaagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaagagagagctgaagaagaagaaagagaaaagagggctgctgcactggaagcatgtttggatgtaaccaagcagaaagatctcagtggattttataggcacctattaaatcaagcagttggtgaagaggaagtacctaaatgcagctttcgtgaagccagatctggtataaaggaagaaaaatcaaggggcttctccaatgaagtaagttcaaaaaacagaataccacaagagaaatgcattcttcaaactgatgtgaaagtagaggaaaacccagatgcagacagtgacttcgatgctaagagcagtgcggatgatgaaatagaagaaactagagtgaactgcagaagggaaaaggtcatagagacccctgagaatgacttcaagcaccacaggagtcaaaaccactctcggtcacctagtgaagaaagagggcacagtaccaggcaccacacgaaaggatcacgaacgtcgagaggacatgagaaaagggaagatcagcaccagcagaagcaatccagagaccaagagaaccattacactgaccgtgattaccggaaagaaagggattctcataggcacagagaggccagtcatagagattcccattggaagaggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcactgttcgagaggctgaggcaagaagatcacttgagcctaggaatttgatgttacagtgaggtatgatcatgccactgcactccaacctgggcaacagaatgagaccctgtctctaaaaaattttttttaaataaataatttaactcttctaataatgttttgttgcaggaaatgtatttcagataaaatatggatttgaaaaacagaaaatatactttatgttctgaaatttgtatttaagtataaaatgtgaatcatcttgtctaaatagcttacagcatagttggcttaaatgaaaataaaatgatatgcttata

SEQ ID NO: 73969 - DNA, 1270 bp, Homo sapiens
ctcgtgccggccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 73970 - DNA, 1016 bp, Homo sapiens
ccgcggttcaaaggctcccccgcagtgctttttaaattgacatatgcagtgataacctgctttagcctcaggctcactcacccgcccagaccctggagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 73971 - DNA, 528 bp, Homo sapiens
  misc_feature (20)..(21): n is a, c, g, or t
actagtcacggttggctagnntgggggctgctttcccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggtagatttcctcggagtctatttttcccaccctggccagctcagcctgcctctgtccccctctaccactggcccctttcctccttgagaccccagctttgaggcctcaggataatcatttctccccacagacattccccagcctcatgcagagccctgggccttctctttggacctgggactcaagcaggcagcaggctcaggccacctccttgctcttgggacaccagagaacccatcttggctcagtctccacctccaagatcaaagtaaagggggacagtggggcattgcctgtattcagtggagcc

SEQ ID NO: 73972 - DNA, 1348 bp, Homo sapiens
ctcgtgccggccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggtagatttcctcggagtctatttttcccaccctggccagctcagcctgcctctgtccccctctaccactggcccctttcctccttgagaccccagctttgaggcctcaggataatcatttctccccacagacattccccagcctcatgcagagccctgggccttctctttggacctgggactcaagcaggcagcaggctcaggccacctccttgctcttgggacaccagagaacccatcttggctcagtctccacctccaagatcaatgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 73973 - DNA, 623 bp, Homo sapiens
ctcgtgccggccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttgggggggcctgattattaccccgctttacaaaccttttagtttgcccgttcggaatccttggcaaaggaatgggtt

SEQ ID NO: 73974 - DNA, 1258 bp, Homo sapiens
ctcgtgccggccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggtagatttcctcggagtctatttttcccaccctggccagctcagcctgcctctgtccccctctaccactggcccctttcctccttgagaccccagctttgaggcctcaggataatcatttctccccacagacattccccagcctcatgcagagccctgggccttctctttggacctgggactcaagcaggcagcaggctcaggccacctccttgctcttgggacaccagagaacccatcttggctcagtctccacctccaagatcaagcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 73975 - DNA, 344 bp, Homo sapiens
ccatctacaagctagagaaccaggaacgttggtagagtggctcagtccaagcccaacggcctcagaactgtggaagccactgctgtcgttctcaggccaaaggtctatgaacctggcaggctgctgtgcaagtcctggagttaaaaagtaggaggaactcaagttctgatatctgagggcaagagaagacgggtgtcccatctttagaagagagagagagaattcaccttttctgttctatctgggtgctcagcttattagatggtgcctgccaacattggaggagggtggatcttcctcactcagtctactgatttaaatgccaatctcttccagaaataccc

SEQ ID NO: 73976 - DNA, 486 bp, Homo sapiens
gtaacagaaaagcacctagacactataagcgtattgttttcaggatacgttgcattgaaaacatttctgagttttggtactgttgtaggtaagcgttacaaaccaatgaaataaaagtacctgagaatttttcttattctgtaggatagtttaatgacttggaaaaaccttaaggccattcattcactacttagttctgagcattcttctcacataatggtttatggtttggaagggtgtgaagtgtataagaacagccaaaggatggcttttaggaaacattttgggatcagttgaatcctcttgcaattaaatcaactgatactttaaaaagttgaattttcatgcgttagatcatatttgggtactgaaagtactctgaagtacatgctctttttgcacattgtaattgtatttagggccgggcacggtggctcactcctgtaatcccacccagcactttgggaggctgaggcgggcggatca

SEQ ID NO: 73977 - DNA, 250 bp, Homo sapiens
caatgttgaacagaataagtcttttcaacaatgaatttcaaagtcttttcatcaaacatttgatgcttttataggggtttcccctttcgtttggctctctttctctcttgcctgctgccatgtaagacgtcccattgctcttccttcatcttccaccatgattatgaggcgtctccagccacatggaactgcaaatggagaacctgctctctgggagaaaagtcaaatcggtcccacggctctcttctcc

SEQ ID NO: 73978 - DNA, 482 bp, Homo sapiens
gcattggaaatagcagagtgcttcgcggtaacaggggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaagtacaaatgtactgaggctggagcctgtgtgaacagaacagaagaggccttcactctagtagtgctcacagtccagcagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaag

SEQ ID NO: 73979 - DNA, 370 bp, Homo sapiens
acgaggggggcaacccacaccgtccctttgccacctctctggtcgtccattcccgcctcttgctggagatttagagtccgggaatagggaggcaggagcgcacccgcctgggaaagggctctggggactccgagggcgggggaaggactggggctgagaccactcctccccctgccccgttgccttccttggcgtttgaccctcctttcctttcagatagggtcctggagggtctggcaaagtgcagcgctatgtggagagatgacggccaggccttctccgcaggcccctcttcctcctcctgccctgttaatgctggagcaccagggctcagtcctaagccttctcttcagtttccaccatgtccagt

SEQ ID NO: 73980 - DNA, 270 bp, Homo sapiens
ataattctcaagtgaagaaagaaacagaggtggggatatgggagtagtgagtaggagggaagaacaaacattaatttgccaagaagattctttaaaatatttttgtttgtgtagaagatagagaaagtagtcacctgggaaaatggctggaatctaaaactttatcaataccttcacactgtattaatttagtcgagcagtttgaacattcttttgtttttcttttaaaaatattacactgataaattaaccatgtctataaagggtcaa

SEQ ID NO: 73981 - DNA, 505 bp, Homo sapiens
tcccctcttctgtctacatcttaggtttgggggttttttttgtttgtttttttaattgtggtaaaacacacataacataaaattaccatcttaaccttttttaagtatacagtttaatggcattaggtacatttacagcattgcactaccagctccaccctccatccacagaactcttcatcttgctgaaaactgaagctctgaacctgttaaataatagctctccattttcctctcccctaagcttatctttgtattttaaatgttcttactcatcagaaaagtggttttaatttcataaataatttagccatttatttttaatcaaataaatatcttgtcgtaaacaacaacaaaaaagacactagaagacctatggcttctatgcccacaaagtagataagaacatggaatctgaagccaagttgcccaagtgcaaatactagctccctcactttctacctatatgaccctgggcaagttatttaacatctctatgtctcag

SEQ ID NO: 73982 - DNA, 267 bp, Homo sapiens
tatgatagaaaaaagcaaatacaatacagcttaagaaactctcaggtttctagctcatgaatgcatgtgagtgagtgaaagagaaagagcaaacaaaaaaataaaataagcgcacgtcatggggttcccagccatatgtagttttgctgcctacattctcattttcttttatattctttcaattttttattacccttctttggagcacaaaaacatatgaaaataaaaatacaaccttcgaaatttgtctgttattttaatttcatg

SEQ ID NO: 73983 - DNA, 6738 bp, Homo sapiens
  misc_feature (621)..(621): n is a, c, g, or t
  misc_feature (3196)..(3196): n is a, c, g, or t
  misc_feature (5116)..(5116): n is a, c, g, or t
ggggagatggcgctgtttgagtgcctggtggcggggcccactgacgtggaggtggattggctgtgccgtggccgcctgctgcagcctgcactgctcaaatgcaagatgcatttcgatggccgcaaatgcaagctgctacttacatctgtacatgaggacgacagtggcgtctacacctgcaagctcagcacggccaaagatgagctgacctgcagtgcccggctgaccgtgcggccctcgttggcacccctgttcacacggctgctggaagatgtggaggtgttggagggccgagctgcccgtttcgactgcaagatcagtggcaccccgccccctgttgttacctggactcattttggctgccccatggaggagagtgagaacttgcggctgcggcaggacgggggtctgcactcactgcacattgcccatgtgggcagcgaggacgaggggctctatgcggtcagtgctgttaacacccatggccaggcccactgctcagcccagctgtatgtagaagagccccggacagccgcctcaggccccagctcgaagctggagaagatgccatccattcccgaggagccagagcagggtgagctggagcggctgtccattccngacttcctgcggccactgcaggacctggaggtgggactggccaaggaggccatgctagagtgccaggtgaccggcctgccctaccccaccatcagctggttccacaatggccaccgcatccagagcagcgacgaccggcgcatgacacagtacagggatgtccatcgcttggtgttccctgccgtggggcctcagcacgccggtgtctacaagagcgtcattgccaacaagctgggcaaagctgcctgctatgcccacctgtatgtcacagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggcccaaccctggaggaggcccctgccatgctggacaaaccagacatcgtgtatgtggtggagggacagcctgccagcgtcaccgtcacattcaaccatgtggaggcccaggtcgtctggaggagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcagaggcccctcggtttgagtccatcatggaggacgtggaggtgggggctggggaaactgctcgctttgcggtggtggtcgagggaaaaccactgccggacatcatgtggtacaaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcagctcagacagctatggaggtcgagggggtcggggaggatgaggaccatcgaggaaggagactcagcgacttttatgacatccaccaggagatcggcaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctctgcacagaggagctgctggagcgaatcgccaggaaacccaccgtgtgtgagtctgagatccgggcctatatgcggcaggtgctagagggaatacactacctgcaccagagccacgtgctgcacctcgatgtcaagcctgagaacctgctggtgtgggatggtgctgcgggcgagcagcaggtgcggatctgtgactttgggaatgcccaggagctgactccaggagagccccagtactgccagtatggcacacctgagtttgtagcacccgagattgtcaatcagagccccgtgtctggagtcactgacatctggcctgtgggtgttgttgccttcctctgtctgacaggaatctccccgtttgttggggaaaatgaccggacaacattgatgaacatccgaaactacaacgtggccttcgaggagaccacattcctgagcctgagcagggaggcccggggcttcctcatcaaagtgttggtgcaggaccggctgagacctaccgcagaagagaccctagaacatccttggttcaaaactcaggcaaagggcgcagaggtgagcacggatcacctgaagctattcctctcccggcggaggtggcagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccngcccgggagccacccgcctggcccggggaggcctgggtgagggcgagtatgcccagaggctgcaggccctgcgccagcggctgctgcggggaggccccgaggatggcaaggtcagcggcctcaggggtcccctgctggagagcctggggggccgtgctcgggacccccggatggcacgagctgcctccagcgaggcagcgccccaccaccagcccccactcgagaaccggggcctgcaaaagagcagcagcttctcccagggtgaggcggagccccggggccggcaccgccgagcgggggcgcccctcgagatccccgtggccaggcttggggcccgtaggctacaggagtctccttccctgtctgccctcagcgaggcccagccatccagccctgcacggcccagcgcccccaaacccagtacccctaagtctgcagaaccttctgccaccacacctagtgatgctccgcagccccccgcaccccagcctgcccaagacaaggctccagagcccaggccagaaccagtccgagcctccaagcctgcaccacccccccaggccctgcaaaccctagcgctgcccctcacaccctatgctcagatcattcagtccctccagctgtcaggccacgcccagggcccctcgcagggccctgccgcgccgccttcagagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcagccccaggggaaagccgaagccggctccgctggggcttctctcggccgcggaaggacaaggggttatcgccaccaaacctctctgccagcgtccaggaggagttgggtcaccagtacgtgcgcagtgagtcagacttccccccagtcttccacatcaaactcaaggaccaggtgctgctggagggggaggcagccaccctgctctgcctgccagcggcctgccctgcaccgcacatctcctggatgaaagacaagaagtccttgaggtcagagccctcagtgatcatcgtgtcctgcaaagatgggcggcagctgctcagcatcccccgggcgggcaagcggcacgccggtctctatgagtgctcggccaccaacgtactgggcagcatcaccagctcctgtaccgtggctgtggcccgagtcccaggaaagctagctcctccagaggtancccagacctaccaggacacggcgctggtgctgtggaagccgggagacagccgggcaccttgcacgtatacgctggagcggcgagtggatggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgcaggctgcccggccagcggagcccaccctacccagtacccacgtcaccccaagtgagcccaagcctttcgtccttgacactgggaccccgatcccagcctccactcctcaaggggttaaaccagtgtcttcctctactcctgtgtatgtggtgacttcctttgtgtctgcaccaccagcccctgagcccccagcccctgagccccctcctgagcctaccaaggtgactgtgcagagcctcagcccggccaaggaggtggtcagctcccctgggagcagtccccgaagctctcccaggcctgagggtaccactcttcgacagggtccccctcagaaaccctacaccttcctggaggagaaagccaggggccgctttggtgttgtgcgagcgtgccgggagaatgccacggggcgaacgttcgtggccaagatcgtgccctatgctgccgagggcaagcggcgggtcctgcaggagtacgaggtgctgcggaccctgcaccacgagcggatcatgtccctgcacgaggcctacatcacccctcggtacctcgtgctcattgctgagagctgtggcaaccgggaactcctctgtgggctcagtgacaggttccggtattctgaggatgacgtggccacttacatggtgcagctgctacaaggcctggactacctccacggccaccacgtgctccacctagacatcaagccagacaacctgctgctggcccctgacaatgccctcaagattgtggactttggcagtgcccagccctacaacccccaggcccttaggccccttggccaccgcacgggcacgctggagttcatggctccggagatggtgaagggagaacccatcggctctgccacggacatctggggagcgggtgtgctcacttacattatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggtgaccagccatccagctgtctgtctgtctgccacaaggaaataaaaatggcaagcagcataacctgtgt

SEQ ID NO: 73984 - DNA, 8288 bp, Homo sapiens
  misc_feature (621)..(621): n is a, c, g, or t
  misc_feature (3196)..(3196): n is a, c, g, or t
  misc_feature (5116)..(5116): n is a, c, g, or t
ggggagatggcgctgtttgagtgcctggtggcggggcccactgacgtggaggtggattggctgtgccgtggccgcctgctgcagcctgcactgctcaaatgcaagatgcatttcgatggccgcaaatgcaagctgctacttacatctgtacatgaggacgacagtggcgtctacacctgcaagctcagcacggccaaagatgagctgacctgcagtgcccggctgaccgtgcggccctcgttggcacccctgttcacacggctgctggaagatgtggaggtgttggagggccgagctgcccgtttcgactgcaagatcagtggcaccccgccccctgttgttacctggactcattttggctgccccatggaggagagtgagaacttgcggctgcggcaggacgggggtctgcactcactgcacattgcccatgtgggcagcgaggacgaggggctctatgcggtcagtgctgttaacacccatggccaggcccactgctcagcccagctgtatgtagaagagccccggacagccgcctcaggccccagctcgaagctggagaagatgccatccattcccgaggagccagagcagggtgagctggagcggctgtccattccngacttcctgcggccactgcaggacctggaggtgggactggccaaggaggccatgctagagtgccaggtgaccggcctgccctaccccaccatcagctggttccacaatggccaccgcatccagagcagcgacgaccggcgcatgacacagtacagggatgtccatcgcttggtgttccctgccgtggggcctcagcacgccggtgtctacaagagcgtcattgccaacaagctgggcaaagctgcctgctatgcccacctgtatgtcacagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggcccaaccctggaggaggcccctgccatgctggacaaaccagacatcgtgtatgtggtggagggacagcctgccagcgtcaccgtcacattcaaccatgtggaggcccaggtcgtctggaggagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcagaggcccctcggtttgagtccatcatggaggacgtggaggtgggggctggggaaactgctcgctttgcggtggtggtcgagggaaaaccactgccggacatcatgtggtacaaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcagctcagacagctatggaggtcgagggggtcggggaggatgaggaccatcgaggaaggagactcagcgacttttatgacatccaccaggagatcggcaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctctgcacagaggagctgctggagcgaatcgccaggaaacccaccgtgtgtgagtctgagatccgggcctatatgcggcaggtgctagagggaatacactacctgcaccagagccacgtgctgcacctcgatgtcaagcctgagaacctgctggtgtgggatggtgctgcgggcgagcagcaggtgcggatctgtgactttgggaatgcccaggagctgactccaggagagccccagtactgccagtatggcacacctgagtttgtagcacccgagattgtcaatcagagccccgtgtctggagtcactgacatctggcctgtgggtgttgttgccttcctctgtctgacaggaatctccccgtttgttggggaaaatgaccggacaacattgatgaacatccgaaactacaacgtggccttcgaggagaccacattcctgagcctgagcagggaggcccggggcttcctcatcaaagtgttggtgcaggaccggctgagacctaccgcagaagagaccctagaacatccttggttcaaaactcaggcaaagggcgcagaggtgagcacggatcacctgaagctattcctctcccggcggaggtggcagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccngcccgggagccacccgcctggcccggggaggcctgggtgagggcgagtatgcccagaggctgcaggccctgcgccagcggctgctgcggggaggccccgaggatggcaaggtcagcggcctcaggggtcccctgctggagagcctggggggccgtgctcgggacccccggatggcacgagctgcctccagcgaggcagcgccccaccaccagcccccactcgagaaccggggcctgcaaaagagcagcagcttctcccagggtgaggcggagccccggggccggcaccgccgagcgggggcgcccctcgagatccccgtggccaggcttggggcccgtaggctacaggagtctccttccctgtctgccctcagcgaggcccagccatccagccctgcacggcccagcgcccccaaacccagtacccctaagtctgcagaaccttctgccaccacacctagtgatgctccgcagccccccgcaccccagcctgcccaagacaaggctccagagcccaggccagaaccagtccgagcctccaagcctgcaccacccccccaggccctgcaaaccctagcgctgcccctcacaccctatgctcagatcattcagtccctccagctgtcaggccacgcccagggcccctcgcagggccctgccgcgccgccttcagagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcagccccaggggaaagccgaagccggctccgctggggcttctctcggccgcggaaggacaaggggttatcgccaccaaacctctctgccagcgtccaggaggagttgggtcaccagtacgtgcgcagtgagtcagacttccccccagtcttccacatcaaactcaaggaccaggtgctgctggagggggaggcagccaccctgctctgcctgccagcggcctgccctgcaccgcacatctcctggatgaaagacaagaagtccttgaggtcagagccctcagtgatcatcgtgtcctgcaaagatgggcggcagctgctcagcatcccccgggcgggcaagcggcacgccggtctctatgagtgctcggccaccaacgtactgggcagcatcaccagctcctgtaccgtggctgtggcccgagtcccaggaaagctagctcctccagaggtancccagacctaccaggacacggcgctggtgctgtggaagccgggagacagccgggcaccttgcacgtatacgctggagcggcgagtggatggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgcaggctgcccggccagcggagcccaccctacccagtacccacgtcaccccaagtgagcccaagcctttcgtccttgacactgggaccccgatcccagcctccactcctcaaggggttaaaccagtgtcttcctctactcctgtgtatgtggtgacttcctttgtgtctgcaccaccagcccctgagcccccagcccctgagccccctcctgagcctaccaaggtgactgtgcagagcctcagcccggccaaggaggtggtcagctcccctgggagcagtccccgaagctctcccaggcctgagggtaccactcttcgacagggtccccctcagaaaccctacaccttcctggaggagaaagccaggggccgctttggtgttgtgcgagcgtgccgggagaatgccacggggcgaacgttcgtggccaagatcgtgccctatgctgccgagggcaagcggcgggtcctgcaggagtacgaggtgctgcggaccctgcaccacgagcggatcatgtccctgcacgaggcctacatcacccctcggtacctcgtgctcattgctgagagctgtggcaaccgggaactcctctgtgggctcagtgacaggttccggtattctgaggatgacgtggccacttacatggtgcagctgctacaaggcctggactacctccacggccaccacgtgctccacctagacatcaagccagacaacctgctgctggcccctgacaatgccctcaagattgtggactttggcagtgcccagccctacaacccccaggcccttaggccccttggccaccgcacgggcacgctggagttcatggctccggagatggtgaagggagaacccatcggctctgccacggacatctggggagcgggtgtgctcacttacattatgtgagtgtcccctaccccaccgcagccctctctgcccatacagtgagctcccggactcaccttctgccaacaccctctcccccgtgccccacctcccctgtacacacatccacactgcacactcacactcaggtgcacagtagcatggccctgagcactgtgcacctgacactaatgtccttctgggtctgggtgttggcctccggtctgcatatgtcaatcaagctatcttccccaacaggctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggtgagtgagccccacacctgctatcccccagtgttacctgcccctggcctggcctgtgccagagatctcccagctcctcccctgctcctaggaagaagtctgctgcttctactaaatggtcatactacccaccatttaaagcctgaggcagccccgtgcaaggcagactcactgtccccattccggagactggggaactgagctcttgagctgcccaagatcacacatgtaggggtgggatccaggactgggacatgggtctgcgggaggacagagccccggcagctcccagagcttccttccaggttcatcatccctggctctgcctggcaggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaaggtgctgctgcgctcctaccctggcggcccctagaggcacggaccacagccaggcctcgggcttcaactggggttcccaccaatgccacgggacattccagggcccacgctgagccaggcgggcctggggcttcggttaccaccagcagcaacatctggctgggctcttacctcatagaccttcaaggacagagaccccagggcctggacctgatgccaccccaggccaaagccagagtgggagacccattggtcaggctcagcagggtgggaacaggcagagggacaagaggggaatggagaagtggagaggaaaaggaatcgagggacaggaagggggaggctctaggaaggttctgggttgggggtcagtgcatctcagggagaaccaaggaaggtgggcatggctggagaggaggaaaaggaaggagccccaggtgtcagggcagtaggctgggagtcagtgtggcaaagcgggggcaggacacagatacagtggcaggggcccagggctgggacatgagagaaggcagcgaggcggcagagggagaagagaggactcaggtggaggtggggtgggtcagctgtcagcatccctcagaggagaaatgtggagagctggaggccagcagtcactcacactcgctctgtcctcctgtccagtggatacagccctgggcgctctgctggcccaaggatgtccccactgcccctccatggcctctggccttcttcccattcatatttatttatttattgacttttatgaagtttccccttccatccgatccctactgcccatgttgtcctgaccatccctcccagccatccagctgtctgtctgtctgccacaaggaaataaaaatggcaagcagcataacctgtgt

SEQ ID NO: 73985 - DNA, 2089 bp, Homo sapiens
ctctggagttctggggaccccgccattttgtgcctgggttaattcctcaggtgacccatatgtctcttggggtatgccaccacctctgtcctgcctactggccttcagggcctgccactctggacattcccatggtctggtgaccaggacattgtcctgctgctcaagcacccagggacctcccccgcccccacttccctgccaccaggaagctgggtcagcttggcctctgtctcctgtcagctccggagatggtgaagggagaacccatcggctctgccacggacatctggggagcgggtgtgctcacttacattatgtgagtgtcccctaccccaccgcagccctctctgcccatacagtgagctcccggactcaccttctgccaacaccctctcccccgtgccccacctcccctgtacacacatccacactgcacactcacactcaggtgcacagtagcatggccctgagcactgtgcacctgacactaatgtccttctgggtctgggtgttggcctccggtctgcatatgtcaatcaagctatcttccccaacaggctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggtgagtgagccccacacctgctatcccccagtgttacctgcccctggcctggcctgtgccagagatctcccagctcctcccctgctcctaggaagaagtctgctgcttctactaaatggtcatactacccaccatttaaagcctgaggcagccccgtgcaaggcagactcactgtccccattccggagactggggaactgagctcttgagctgcccaagatcacacatgtaggggtgggatccaggactgggacatgggtctgcgggaggacagagccccggcagctcccagagcttccttccaggttcatcatccctggctctgcctggcaggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaaggtgctgctgcgctcctaccctggcggcccctagaggcacggaccacagccaggcctcgggcttcaactggggttcccaccaatgccacgggacattccagggcccacgctgagccaggcgggcctggggcttcggttaccaccagcagcaacatctggctgggctcttacctcatagaccttcaaggacagagaccccagggcctggacctgatgccaccccaggccaaagccagagtgggagacccattggtcaggctcagcagggtgggaacaggcagagggacaagaggggaatggagaagtggagaggaaaaggaatcgagggacaggaagggggaggctctaggaaggttctgggttgggggtcagtgcatctcagggagaaccaaggaaggtgggcatggctggagaggaggaaaaggaaggagccccaggtgtcagggcagtaggctgggagtcagtgtggcaaagcgggggcaggacacagatacagtggcaggggcccagggctgggacatgagagaaggcagcgaggcggcagagggagaagagaggactcaggtggaggtggggtgggtcagctgtcagcatccctcagaggagaaatgtggagagctggaggccagcagtcactcacactcgctctgtcctcctgtccagtggatacagccctgggcgctctgctggcccaaggatgtccccactgcccctccatggcctctggccttcttcccattcatatttatttatttattgacttttatgaagtttccccttccatccgatccctactgcccatgttgtcctgaccatccctcccagccatccagctgtctgtctgtctgccacaaggaaataaaaatggcaagcagcataacctgtgt

SEQ ID NO: 73986 - DNA, 959 bp, Homo sapiens
cgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtaagttcatgttcgctctggatctattctcctggaaaaattctgggcctttgtttttcttgtatttctgccagagtatacccaaaaaataattttttaatgcatatttataaagcttctgaggaagacctagaat

SEQ ID NO: 73987 - DNA, 884 bp, Homo sapiens
cgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggatcttgctctgtcccccagactggagagtagtggtgcgatgattgctcactttaaccttgaacttcaagactcaagtgatcctccctattgcccaggctggaatgcagtggtgcaatctccactcactgcaacctccgcctcccagattcaagcaattctcctgcctcagtctgccaccacacccggctaacttttatatctttagtagagacgtggtttcaccttgttggccttgctggtctcaaactcctgacctcgagtgatcctcccacctc

SEQ ID NO: 73988 - DNA, 328 bp, Homo sapiens
cttgtgaggaaggcatcttgcttcccctttgcctcctgacatgattgtgaatttcctgaggcctctccagccgtgatgaactcacccacctcaactaccagcatcagaaaacaagttctgaccgggtgcagtggctcacacctgtaagagtggctcacactttgggaggccaagattctctgcaaaacttctggacaactgacatctccctaaatgtgatattctcatacacccccatcttctgatgtttaaattgtaacctatgacaatacttctagatgtcaaaacaatagtgattaaacattcaacggttaccttctaaatatga

SEQ ID NO: 73989 - DNA, 977 bp, Homo sapiens
cgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaaattctctgcaaaacttctggacaactgacatctccctaaatgtgatattctcatacacccccatcttctgatgtttaaattgtaacctatgacaatacttctagatgtcaaaacaatagtgattaaacattcaacggttaccttctaaatatga

SEQ ID NO: 73990 - DNA, 265 bp, Homo sapiens
cttgtgaggaaggcatcttgcttcccctttgcctcctgacatgattgtgaatttcctgaggcctctccagccgtgatgaactgtgagtcaattaaaactctttcctttataaattacccagtctcaggctgttctttatagcagtatgaaagctgactaacacaatggggtctgactatgttgcccagactggtctcaaactcttgggctcacgtaatcctactgcctcagcctcccaaaatgctggaattacaggtgtgaggtg

SEQ ID NO: 73991 - DNA, 4620 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaagtgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactaaaaaaaaatg

SEQ ID NO: 73992 - DNA, 755 bp, Homo sapiens
agtcagtctcaatgtgagaacctgggtatttcagttgaaggtgctgcatttaataagctttttcattccactccgtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggaggtaaaacagcaatttgcttttaattttatttcatgtccaacaatattactatgcccaaaatgctaaaatgaggtaatgtagccctatttccactttatacacacaaagaaaccaagattcaaattaattgtttcttgctgaggtgacttagctggtgatagctagaactgatcagagatttttttttagatacatccgatacttcagggcacaaaatcagataaaatacaagattctgatgtactgtaagagagggaaaatgctgacaatggaaagaaagagtaattctgattatggaaacaggaaagacattcatagggatgctgtattttaaaaaacataaagaaggacaaagggcttcactggtgacaagaaacaacgtgaacatcacagaaatatctcataatccatgg

SEQ ID NO: 73993 - DNA, 4371 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactaaaaaaaaatg

SEQ ID NO: 73994 - DNA, 4421 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgagggctctgacatcctggctgagactacatatgggtcgtctttctaagtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactaaaaaaaaatg

SEQ ID NO: 73995 - DNA, 4938 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgagggctctgacatcctggctgagactacatatgggtcgtctttctaagtgacaaatcagacgctaagtttttccttcatggttctgcaagacatcccagtaggagacttgaagccagcaattgttaaagtctatgattactatgagacagatgagtctgtggttgctgagtatatcgccccctgcagcacaggtaagagttcaccacttatgaccagtactagatggcattaacccactctccaagggcccctgcaatttaaattctctacaaggcttttcctacatctgagacaatccacatggcatgtcctcacaccaagacaaaactgtggcgtagcatgcctattctgtagcggactctccaatttcagatattcactcccagaaaagtcaataagctttgtttatttgtaggacagctatctctaaaagcgacatttcacttcacagctaattgggcttccttcaacacaatggtcaactaatcacacacctaaaaccaaatctagccttacacttaattttgtaaatgaagctttattggcacatggccacacttattattaacattggctatggctgcctttgtgtgctgattagtcatgacagaccacatggcatataaacctaaaataattaccatctggcctttcacaaagtttcctgaccctgcataagctcactctgctgcccacactcaactgaatgctcctcaggaaatgatacaacctccttacgtttttcttttctccaggtggattctctgtcctatacatttacttagaaggaatggagttatttgtctctataaaatagacactaaaaatatttgctgaataaatatgtacttctggtcaaactaaaaaaaaatg

SEQ ID NO: 73996 - DNA, 4984 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgagggctctgacatcctggctgagactacatatgggtcgtctttctaagtgacaaatcagacgctaagtttttccttcatggttctgcaagacatcccagtaggagacttgaagccagcaattgttaaagtctatgattactatgagacagatgagtctgtggttgctgagtatatcgccccctgcagcacaggtaagagttcaccacttatgaccagtactagatggcattaacccactctccaagggcccctgcaatttaaattctctacaaggcttttcctacatctgagacaatccacatggcatgtcctcacaccaagacaaaactgtggcgtagcatgcctattctgtagcggactctccaatttcagatattcactcccagaaaagtcaataagctttgtttatttgtaggacagctatctctaaaagcgacatttcacttcacagctaattgggcttccttcaacacaatggtcaactaatcacacacctaaaaccaaatctagccttacacttaattttgtaaatgaagctttattggcacatggccacacttattattaacattggctatggctgcctttgtgtgctgattagtcatgacagaccacatggcatataaacctaaaataattaccatctggcctttcacaaagtttcctgaccctgcataagctcactctgctgcccacactcaactgaatgctcctcaggaaatgatacaacctccttacgtttttcttttctccaatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactaaaaaaaaatg

SEQ ID NO: 73997 - DNA, 4499 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgagggctctgacatcctggctgagactacatatgggtcgtctttctaagtgacaaatcagacgctaagtttttccttcatggttctgcaagacatcccagtaggagacttgaagccagcaattgttaaagtctatgattactatgagacaggtgagtgaaagaaaaatgaaacaatcttaaccagagccaagaaatggatcctgttgtgacagttgatcctcttcttagcccacttagtcaacattaatcttttgtttctttcctccaagatgtacactataaaaacgacttactacagtctggccaacatagcaaaaccccatctctactaaaaatacaagaggcaggagaatcgtgtaagcctgggaggcagaggttgcagtgagctgagatcacgccattgcactccagcccaggtgacggtgcgagactccg

SEQ ID NO: 73998 - DNA, 873 bp, Homo sapiens
atcctgtttaattcttgtctatttacatgaagttttgacaattctgatagggcgtgcttttctccagtagtaaagtgactagacagatttagcatggtccctagttcatagatctttcgtttcttccttcacccaacgttatctttcagatgagtctgtggttgctgagtatatcgccccctgcagcacaggtaagagttcaccacttatgaccagtactagatggcattaacccactctccaagggcccctgcaatttaaattctctacaaggcttttcctacatctgagacaatccacatggcatgtcctcacaccaagacaaaactgtggcgtagcatgcctattctgtagcggactctccaatttcagatattcactcccagaaaagtcaataagctttgtttatttgtaggacagctatctctaaaagcgacatttcacttcacagctaattgggcttccttcaacacaatggtcaactaatcacacacctaaaaccaaatctagccttacacttaattttgtaaatgaagctttattggcacatggccacacttattattaacattggctatggctgcctttgtgtgctgattagtcatgacagaccacatggcatataaacctaaaataattaccatctggcctttcacaaagtttcctgaccctgcataagctcactctgctgcccacactcaactgaatgctcctcaggaaatgatacaacctccttacgtttttcttttctccaggtggattctctgtcctatacatttacttagaaggaatggagttatttgtctctataaaatagacactaaaaatatttgctgaataaatatgtacttctggtcaaactaaaaaaaaatg

SEQ ID NO: 73999 - DNA, 3655 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggtcagtggttcccaaagagtcttctgctccaggttcacttggcaattgggaggcttaaaagtagaacagttaatggaaaagagaaggcaattattaaatca

SEQ ID NO: 74000 - DNA, 433 bp, Homo sapiens
agtgacgtgatctcggctcactgcaagctccgcctcctgggttcacgccattctcctgcctcagcctcccgagtagctgggactacaggcgcccgccaccacgcccggctaatttttttgtatttttagtagagacggggtttcaccgtgttcaccaggatggtctcgatatcctgacctcatgatccgcccgcctcggcctcccaaagtgctgggattacaggcgatagctgctattcttattaggattctggaagtcacactctgtgtatataacttttctcttacctaaatgatagactctgaatataaaggccatttttgttaataatgttggctatttatgaactgaaattattctgacatctaatctttcacattccccaggtgacatattaggttctgctatgcaaaatatacaaaatctcctcca

SEQ ID NO: 74001 - DNA, 345 bp, Homo sapiens
tggttgatgcattaagagagatttacacttgcccagtaatgcccatagactatgtatcaaaaccaatcctaaaaacaggttctctagtcttattctttaagactgaactataaagggaagagatcgaaatatttttctatttaaatatgatgaatatctagctgtctgcctatctgtctgaaatctattaataacatctgactgtcaatatccagctctcagcttgctctgccctctattcaccctagtttgacacaaccacattttgcctttacagaaccctattgttcgcaatgccctgttctgcctggagtcagcctggaatgtagcaaaggaggggaccca

SEQ ID NO: 74002 - DNA, 485 bp, Homo sapiens
agactttgggggaaaatcccagatgccaaaaatttactctttggggcggttgtccactcgtctcttccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcaggtagggctccaagcttatatgggtgagagtcaactttaaacttgccaattgaaatggaaactctgttccttccttcctgggaaagtaaaaggcacctctggagacgttaagtaatgaggaagtgaggggtccagaaaaagagagaaactgatagtgtctttgctgtttcacagacatccatgaaatacaatattct

SEQ ID NO: 74003 - DNA, 499 bp, Homo sapiens
ggaaggccctggtaggctgtactcctctctctcttagggaaaaccagcaccaaagttctagagtctggacgtctgagatcagggtgccagcactgtcgaggtcacagactgcagacctccttgtatcttcaaatggaggaaagaggacaagagagctcctgtggtcccttttatcaagatgaatgcacaaggaaaatgttgtacatttgcacattggagtacacttcagccataaaaagaatgagatgctgtcatttgcaacaacagttgaagcctagtcaagaagagggctcagagaagcttgactaaagtttcatgaagagagtctctgtcagtggtgggtctttgattctcaaggaagctgtcagaagcttcatctaacttctcttccactctactttcttctggggaagaagtgacccaacaatttgatctaatatttgcctgataatattgaacatccttgcatccattaaagtttactgttctaagacttact

SEQ ID NO: 74004 - DNA, 725 bp, Homo sapiens
ggaagactgacttcctcctgctgccaaaggttgcagtgcttatttaagaaattatacctgcttgtctactagaggcagtcagctgaatcatcgagttcttgcagaagccttgagctttagcacctaagggccctgagacagtgtattcaacaaccttgtgcatgaaagaaggggagttctgagggacatggacatgcagactttttcaccaaccaggaaaacttttcaggcatcacccaagaggtccagctgaagatgtaacagttctagagtctggacgtctgagatcagggtgccagcactgtcgaggtcacagactgcagacctccttgtatcttcaaatggaggaaagaggacaagagagctcctgtggtcccttttatcaagatgaatgcacaaggaaaatgttgtacatttgcacattggagtacacttcagccataaaaagaatgagatgctgtcatttgcaacaacagagttgtgcagtcatcagttatcttcatgggacgagtatgtccggaggggaggaaaatctgataaaaaatattgaaattcaatgaaggcttccactgcttaacaaatgttacatagaattcttcaccgatgtgaggaacatcagtttgcaaaagaaactctgcactttcagggataaaaagactgagactccaaatggtgctcctagtattggtgaagcttagggagagagcccattgtgtttctatcta

SEQ ID NO: 74005 - DNA, 754 bp, Homo sapiens
cgaagaaatagacatgacccagaaaactcacgaggaaagaggaaatcgtgtactttgtggaaaccatatccacgtaatgttgttccaggctgtagaaagcaactattgttattccagatactgaagcacagagtctattttgtgccgctggcggtttcattaacatagtaacactctgcctttctagaattgggtgagcagccttccctgtttggaacactgcagagggagactgaaccccacaattgatatcagaaggccccgtgtggatgcctcttcagggtgccttccacagagctctgccagcatgctgaggctgcggggaaaaaccatgaagcctcataaatatatacaatgattgtgtgtacccataatcattagaaataaaaatttaaaaaaacacataaaaccacaagggctctgattgctgggtctaggacttccccactccgacagtgatggtagcagaaacaaggcctgacagccagaccccagggcaggcagcagggaggaaaacagatttaaaaatcgcaccagacactcattttctacagaagtctgcgtgtcgttaatacatgggcaaacagccctttgttccttagtaggccttaaagacaccaccccatgggagctttctaaaaaagatagtattaaaagactatgattcaggctgggcacattagcacacacctgtaatctcagcactttggaaggtcgaggagggcagatcacttgagtctaggagtttgagacc

SEQ ID NO: 74006 - DNA, 628 bp, Homo sapiens
aaattggcctcacaacaaagggactcccttcacttgcctcaagtcaggatcatgggaaggggcagatgtctgctgagactgatgtgaggtcttttacctcagaaaattttacctgagtcattaaaataaaacccctttcaaaaaatttctttaagaaaaactagtgtaataaaaagtaggtcctattagagaacttaccaaacaccaagaacattctaacggcggaggctgtcaactagcatattgaggctatggtccttgttgaacaggttttgtcatctgatactgataatatttagaaatctaagatgcctttggagtataatatgttcaaaaaatgtggttatcttggtctgtgattacagcatatgtccatgctaaggagtttgtttcaggacaggaataagtcctcttctgttaagcagtttctcctaaatcagtttggagacatttcaggagcttttctaacacccaagctgaaattattggcttcttctctgattaaaaccatcccagcagttagcaaacaataaccagaaggttttcaatgtagcccctgtgcacccttcagaaaacatcttgaaacagtactgtaaatagattcaagaaaggaatgtggtttggaaaa

SEQ ID NO: 74007 - DNA, 371 bp, Homo sapiens
gaagccagagtgtggatagcttattcttggtcaagtcaccaaggatgatgacagcaaaaggaaaggagacaaaactgatgattcattcaactcatatttcttgtactcttactgtgtgccaggactgttctaggcactagagttacaacaggcaaaaattcctgccatcatggaccttacattttagtggagggaaggagaagattcagtaaataagttatatttatatgagaagacggtgaggcctgtggagaaaatacttgctctttcattatgagattgcctactcagtttcaaagcaggggaggttataacttaaaaaaatttacactggcacctatgcttaatttctaactctgttggagttttgg

SEQ ID NO: 74008 - DNA, 439 bp, Homo sapiens
agaggtccccaacccttaggagctgggccacacagcaggaggtgtgcagtggaccggtgaacatcaccacctgagctctgcctcctgtcagatcagcggtggcattagattctcataggattgcaaaccttactgtgaactgcgcatgcaagggatctgggttgcgtgcttcttatgagaatctaatgcctgatgatctgaggtagaacagtttcatcccataaccatcctcctcaccgcctgcaccatctggggaaaaattattttccaccaaacaggtccctggtgccaaaaaggttggggactgctgctcttaggacagaaagaaagaagttccataactagagtaaaatatcaccttacagtatgaggtagcttaactgtggatttactttgttaccttgcccctcagtggggagagaagctctggaatttaaaa

SEQ ID NO: 74009 - DNA, 8565 bp, Homo sapiens
cttgagtgttagagctgagtagttttcccagaatctctaagtcctttttatgctcttttatgaatgaatagaattagtaaaagataaataaattttttcttttggatttcttaaccagtggaaaaaatgttgactttaaaagttcataaaatcaaattttgcttaagaatatgttatttccacttgtgaggccagcctggtagacctctgggatccttttctgttcactcacacaccactgagataaggagtgaagtgtgggctaaatagggctgaggcttgggcaagggcatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcaaaaaaaaa

SEQ ID NO: 74010 - DNA, 3759 bp, Homo sapiens
gcctgatggaaacaagggtgaacctggtgtggttggtgctgtgggcactgctggtccatctggtcctagtggactcccaggagagaggggtgctgctggcataccaggagcaccacgagcaccatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactattcatgtagtaaggtgggaaccttcgcctgcggtagggccggcgttgttgggcctggccttcgggagcactctccgatccctcgttcttttcc

SEQ ID NO: 74011 - DNA, 510 bp, Homo sapiens
ctgcacttcagcctgggtgacagagcaagaccctgtcttaaataaataaataagtctcttagttgaattgattcatagtattctattttttgttctctgaaatgataggtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtagggtccaaccagatcattcttaaaacatgctaaggaatgggcggatccagtgcacggatggcattacttcactattaatccgataactaacaaagcatggaaatgtggttggcttgtcttttgagggaggggcatttctaatcacactgaaatgcagtggaaacatttagtctaataaaatgatttttctcagtgaaaatt

SEQ ID NO: 74012 - DNA, 9111 bp, Homo sapiens
  misc_feature (2357)..(2357): n is a, c, g, or t
gcctgatggaaacaagggtgaacctggtgtggttggtgctgtgggcactgctggtccatctggtcctagtggactcccaggagagaggggtgctgctggcataccaggagcaccacgagcaccatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggcaagtcgtttctgtttccttttatattttctcaaacataacatatttttatttaaaaatatgccctttgganggccattatccttagcaaactaacacaggaacgtaaaaccaaatactgcataataatgagagctaaatgatgagaatacatggacacatagaggggaataacagacaccggagcctgttggacgggagaggatgggaggagggagaggatccggaaaagtaactgttgagtactgggcttaatgccggggtgatgaagtcatctgtacaacaaactcccataacacaagttcacctgtgtaacaaacctgcacatgtaccgctgaacttaaaagttttaaaagaaaatgaatttgagcaacatgcaattatatggatgaatcatatcattataacatgaaaaagtgatatgtacatgcagcattaattctttgtaaatttaacaactgcaataataacgatgatgataaacggatatctccagatttaataaactatctaaaaatttaaaaaggaaaagtttacaccctctgcatttttggatgttccttttcacatttccttgttgaagggcatgaactgcgtgtccaggaaatttgggactgtgttgctgtaccttagctgtgtttgcttattcaagagatcttcattaagtacccaaatgtactgggcattgtcctggtcacccagacacaaagatgggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcaaaaaaaaa

SEQ ID NO: 74013 - DNA, 7893 bp, Homo sapiens
  misc_feature (1139)..(1139): n is a, c, g, or t
ggatgaccctcaggtggtagaactacctaagaaaacatcatttttgttctgggaactcttgttcaaatctcttttcaatggtcactgatatttgctaactttaaaattatgtggtcttatttaacagaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggcaagtcgtttctgtttccttttatattttctcaaacataacatatttttatttaaaaatatgccctttgganggccattatccttagcaaactaacacaggaacgtaaaaccaaatactgcataataatgagagctaaatgatgagaatacatggacacatagaggggaataacagacaccggagcctgttggacgggagaggatgggaggagggagaggatccggaaaagtaactgttgagtactgggcttaatgccggggtgatgaagtcatctgtacaacaaactcccataacacaagttcacctgtgtaacaaacctgcacatgtaccgctgaacttaaaagttttaaaagaaaatgaatttgagcaacatgcaattatatggatgaatcatatcattataacatgaaaaagtgatatgtacatgcagcattaattctttgtaaatttaacaactgcaataataacgatgatgataaacggatatctccagatttaataaactatctaaaaatttaaaaaggaaaagtttacaccctctgcatttttggatgttccttttcacatttccttgttgaagggcatgaactgcgtgtccaggaaatttgggactgtgttgctgtaccttagctgtgtttgcttattcaagagatcttcattaagtacccaaatgtactgggcattgtcctggtcacccagacacaaagatgggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcaaaaaaaaa

SEQ ID NO: 74014 - DNA, 5966 bp, Homo sapiens
gccaccgccggcccccgggaagccgcgatcatgaacccccagtgcgcccgttgcggaaaagtcgtgtatcccaccgagaaagtcaactgcctggataagtattggcataaaggatgtttccattgtgaggtctgcaagatggcactcaacatgaacaactacaaaggctatgaaaagaagccctattgtaatgcacactacccgaagcagtccttcaccacggtggcagatacacctgaaaatcttcgcctgaagcagcaaagtgaattgcagagtcaggtcaagtacaaaagagattttgaagaaagcaaagggaggggcttcagcatcgtcacggacactcctgagctacagagactgaagaggactcaggagcaaatcagtaatgtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcaaaaaaaaa

SEQ ID NO: 74015 - DNA, 8570 bp, Homo sapiens
  misc_feature (2357)..(2357): n is a, c, g, or t
gcctgatggaaacaagggtgaacctggtgtggttggtgctgtgggcactgctggtccatctggtcctagtggactcccaggagagaggggtgctgctggcataccaggagcaccacgagcaccatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggcaagtcgtttctgtttccttttatattttctcaaacataacatatttttatttaaaaatatgccctttgganggccattatccttagcaaactaacacaggaacgtaaaaccaaatactgcataataatgagagctaaatgatgagaatacatggacacatagaggggaataacagacaccggagcctgttggacgggagaggatgggaggagggagaggatccggaaaagtaactgttgagtactgggcttaatgccggggtgatgaagtcatctgtacaacaaactcccataacacaagttcacctgtgtaacaaacctgcacatgtaccgctgaacttaaaagttttaaaagaaaatgaatttgagcaacatgcaattatatggatgaatcatatcattataacatgaaaaagtgatatgtacatgcagcattaattctttgtaaatttaacaactgcaataataacgatgatgataaacggatatctccagatttaataaactatctaaaaatttaaaaaggaaaagtttacaccctctgcatttttggatgttccttttcacatttccttgttgaagggcatgaactgcgtgtccaggaaatttgggactgtgttgctgtaccttagctgtgtttgcttattcaagagatcttcattaagtacccaaatgtactgggcattgtcctggtcacccagacacaaagatgggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagta

SEQ ID NO: 74016 - DNA, 4038 bp, Homo sapiens
  misc_feature (2357)..(2357): n is a, c, g, or t
gcctgatggaaacaagggtgaacctggtgtggttggtgctgtgggcactgctggtccatctggtcctagtggactcccaggagagaggggtgctgctggcataccaggagcaccacgagcaccatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggcaagtcgtttctgtttccttttatattttctcaaacataacatatttttatttaaaaatatgccctttgganggccattatccttagcaaactaacacaggaacgtaaaaccaaatactgcataataatgagagctaaatgatgagaatacatggacacatagaggggaataacagacaccggagcctgttggacgggagaggatgggaggagggagaggatccggaaaagtaactgttgagtactgggcttaatgccggggtgatgaagtcatctgtacaacaaactcccataacacaagttcacctgtgtaacaaacctgcacatgtaccgctgaacttaaaagttttaaaagaaaatgaatttgagcaacatgcaattatatggatgaatcatatcattataacatgaaaaagtgatatgtacatgcagcattaattctttgtaaatttaacaactgcaataataacgatgatgataaacggatatctccagatttaataaactatctaaaaatttaaaaaggaaaagtttacaccctctgcatttttggatgttccttttcacatttccttgttgaagggcatgaactgcgtgtccaggaaatttgggactgtgttgctgtaccttagctgtgtttgcttattcaagagatcttcattaagtacccaaatgtactgggcattgtcctggtcacccagacacaaagatgggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggcaagtggttttcttcattttagactatcacaaaggatgtgtcttttattatttacttgcggtcctcctttgcttgtgaaaataaaacttattttcaagaaacatttgtgatgtgtccaataagtacatgtgttatttcagatgacttccaaaagctgccactgcaaacatttacattattttgcaactctttgttatttccagatgtgaccaacagttacattcaaagcttaggttaaaattatattcatttaaacaacgattcatgatatgttagccgtgtctttgaaggtggtaaagcctttgatgtgtgcgttaaataattgtcattttcctgaaatatttcattgaacatggattgttaaatgctgtctgcaaaacaaaataggagatggatcattacccccactaaagacttacagaaaagaatccttaaatacagttaacgtagaattcagttgctcaccaaagtccagtggtgtacatgagtatcttatctgaatattgtgcttcctcttagtgaatatcagggcttcaattctgaattgtacataatgccctcaggtccacagtaagtggtatccatatcttacacctaatcagtttcataaatggcggtgttctgatgggcagttgtgaagaacacaggcccttttcttagcataccctgaatagctgtttgcctgagaatcagcatttaggctttgcaatttacagcttcctagtgacatttctgtccagagatgctgtgtgtatttaacataaattacctttaagttgtggctgcttagaagaacaactaaatttgttcctcattgtttcttattccctaagcagagaaaaaataaaaagaa

SEQ ID NO: 74017 - DNA, 3493 bp, Homo sapiens
  misc_feature (2357)..(2357): n is a, c, g, or t
gcctgatggaaacaagggtgaacctggtgtggttggtgctgtgggcactgctggtccatctggtcctagtggactcccaggagagaggggtgctgctggcataccaggagcaccacgagcaccatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggcaagtcgtttctgtttccttttatattttctcaaacataacatatttttatttaaaaatatgccctttgganggccattatccttagcaaactaacacaggaacgtaaaaccaaatactgcataataatgagagctaaatgatgagaatacatggacacatagaggggaataacagacaccggagcctgttggacgggagaggatgggaggagggagaggatccggaaaagtaactgttgagtactgggcttaatgccggggtgatgaagtcatctgtacaacaaactcccataacacaagttcacctgtgtaacaaacctgcacatgtaccgctgaacttaaaagttttaaaagaaaatgaatttgagcaacatgcaattatatggatgaatcatatcattataacatgaaaaagtgatatgtacatgcagcattaattctttgtaaatttaacaactgcaataataacgatgatgataaacggatatctccagatttaataaactatctaaaaatttaaaaaggaaaagtttacaccctctgcatttttggatgttccttttcacatttccttgttgaagggcatgaactgcgtgtccaggaaatttgggactgtgttgctgtaccttagctgtgtttgcttattcaagagatcttcattaagtacccaaatgtactgggcattgtcctggtcacccagacacaaagatgggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtagggtccaaccagatcattcttaaaacatgctaaggaatgggcggatccagtgcacggatggcattacttcactattaatccgataactaacaaagcatggaaatgtggttggcttgtcttttgagggaggggcatttctaatcacactgaaatgcagtggaaacatttagtctaataaaatgatttttctcagtgaaaatt

SEQ ID NO: 74018 - DNA, 1958 bp, Homo sapiens
gcctgatggaaacaagggtgaacctggtgtggttggtgctgtgggcactgctggtccatctggtcctagtggactcccaggagagaggggtgctgctggcataccaggagcaccacgagcaccatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccaggttggtcatgaatgaagatgctcagaatcgtgtattccaatgtcatgttgccatgtgc

SEQ ID NO: 74019 - DNA, 453 bp, Homo sapiens
agttcttacatttggggaaatgcagtgaattcccacatcatgttttaaattactcagccactaaaaatgaatgtgcatggcgtcattaacataatcattgcctgaaccgtatttttcacactatgtactctaggttcctggaggtgaaaggaatctggacttagagttcttggctacctctggctgcccccgaattagaacagcccatgggggtatgtgtattgggagtggaggagtggacgggtagattgactttttctcaggcatcaatctgttacaaggttcatggtttctatggggccagatgcatgagaggtcaaagcatgggcaataggggttaactgaacgagttgaatgctaggaagtcctcaggggagccaacgttccttgtaaagtgtgtagattttttgttttttaactaaataaaatcttggcactgacaaagttattcct

SEQ ID NO: 74020 - DNA, 407 bp, Homo sapiens
agttcttacatttggggaaatgcagtgaattcccacatcatgttttaaattactcagccactaaaaatgaatgtgcatggcgtcattaacataatcattgcctgaaccgtatttttcacactatgtactctaggttcctggaggtgaaaggaatctggacttagagttcttggctacctctggctgcccccgaattagaacagcccatgggggtatgtgtattgggagtggaggagccctcgtatatgtagacctctgatcgttggcgtaacctatttatatactaccccttgggaagaatttttccattatgatacatattaggttccaccattttcttgtctattcaacgacatttctcgtgtttactctatgttccgttatattgttttctgccatttacatgc

SEQ ID NO: 74021 - DNA, 526 bp, Homo sapiens
acgcatcgagctcgccccacgctcttgataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacaggctgatctcggctcactacagcctctgcctctctggtccaagtgattctcctgcctcggcctcctgagtagctgggattacaggcgcccatccccacccctggctgatttttgtatttttagtagaggcaggtttttgccatatttgccaggctgctctccaactcctgacctcaagtgatccacctgcctcggcctcccaaagtgctgggattacaggtgtgccactgtacctggcctgattgtgtcttttaaattgtaggaaagaattaaaagtcaagttacaaatgaaaagtgcaataatacttgtttctgtatttgatcatttgttgaccttttatgatgagctt

SEQ ID NO: 74022 - DNA, 539 bp, Homo sapiens
ttaacagcttatctttgattaggtacacaaagctctgcttaacaactctgctctttctgttattactggcagaaattaatcctatatattttatgttcccattaacatatgtttataatgtttataatgctttttaaatgagagtgtctttttttttttttctgagatggagtctccttctatctcccaggctgatctcggctcactacagcctctgcctctctggtccaagtgattctcctgcctcggcctcctgagtagctgggattacaggcgcccatccccacccctggctgatttttgtatttttagtagaggcaggtttttgccatatttgccaggctgctctccaactcctgacctcaagtgatccacctgcctcggcctcccaaagtgctgggattacaggtgtgccactgtacctggcctgattgtgtcttttaaattgtaggaaagaattaaaagtcaagttacaaatgaaaagtgcaataatacttgtttctgtatttgatcatttgttgaccttttatgatgagctt

SEQ ID NO: 74023 - DNA, 4174 bp, Homo sapiens
cgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatatagaaataattttgatcatgctccattacttccacaagaacagaaagcacacattagggaaaaagcttataaatgtaatgagcacggccaagtctttagagcatctgcaagccttactaaccaagtaatccataacgcagataatccttacaaatgcagtgaatgtggcaaggtctttagttgcagttcaaagcttgtgatacatcgaagaatgcatactggagagaagccttacaaatgtcatgaatgtggcaagctcttcagtagcaattcaaacctttcacaacatcaaagaattcatactggagagaagccttacaaatgtcatgaatgtgacaaggtctttcgaagcagttcaaagcttgcacaacatcaaagaattcatactggagagaagccttacaaatgtcatgaatgtgacaaggtcttcaatcaaattgcacaccttgtacgacatcaaaaaattcatactggagagaaaccttacagttgtaataaatgtggcaaggtctttagtcgccattcatatctagcagaacatcaaacggttcatactggtgagaaaccttacaaatgtgaagaatgtggcaaagcattttcagtgcgttccagcctcataacccatcagttaattcacactggaaggaaaccttacaaatgtaaagaatgtgacaaggtctttgggcgcaagtgtttcctgacctctcatcagagaattcatactagagagagaccttatggatgcagtcagtgtggcaagatctttagtcagaaatcagaccttatacgacatcgaaaaactcatactgatgagaagccttacaaatgtaataaatgtggcacagcgtttagagagttttcagaccttactgcccattttctaatccatagtggagagaaaccttatgaatgtaaagaatgtggcaaagtcttcaggtacaagtcttctctaaccagtcatcatagaattcatactggagagaagccttacaaatgtaacagatgtggcaaggtcttcagtcgcagttcaaacctggtatgccatcagaaaattcatacaggagaaaagccttacaaatgtaatcaatgtggcaaggtctttaatcaagcatcataccttacaagacatcaaataattcatactggagagaggccttacagatgtagtaaatgtggcaaagcatttcgagggtgttcaggccttactgcccatcttgcaatccatactgaaaagaaatctcatgagtgtaaagaatgtggcaagatcttcactcagaagtcttccctcaccaatcaccatagaattcacattggagagaaaccttacaaatgcaccctgtgcagtaaggtcttcagtcacaattctgaccttgcacagcatcagagagttcattcatgagagtccctacaaactgtgtatggcaaaaccatcatcatgagttctagcattaatcaacatcagtgagtccatactaagtggaaatcatataaatgaaatgtatgtgacacaggctttatcaaggcctgccaaatcactggacatcaccacatcactgtggaggatgaaagcacacagatgaattgtgtgtacttgggctattattcaaggaccattgctatagaacacgataggatttacacaagaagtaactctgtctctggttctctgatactaatctatgatattgcatgatgcagaataatgctaagtcaaaatatgttgaatctcatgacctgatgtatatcaaaggtgcaacggcttgtaaatgaccagttttattcaggctataaagcattcaattatttggggcttatagaaaaggctactttactctttgtgacttcgaaatcttttcatgtgccttccatacaggccattcactgtggtccctgggaaagaatcagtaggatgacagggctgacttcattagctgaggattatttctatccaatttcctgatgaaggacattgccttttgagattaaatattgtctgatttagagagcatggaggtgggcagagtaacataaaactgatgaccgtcatcatactgttgcagttagcacactttctcctgacataagtgcacagagcttcagtgtccaccaactgaccatgaaatagagtatgctgtaatcttaaggcataggttattagtgggaagagagtaataggttgctagtgtctgattatatggtagaaataatgcaaggaaaaaggtagccaccttctccattgaacagcagtacctgctgtttagcaaagactgatgagaagtagacttttttttttttggagatagagtctcactctgttgcccaggctggagtgtagtggtgtgttcttggctcactgcaccctccgcctcctgggctcaagcagtccttctgccttagcctcctaagtagctgagactacagacgtgcgccaccacacccagttcatttttgtatttttagtagaggcagtgtttaccatgttggccaggcaggtctccaactcctgacctcaagtgatatgttcacctcagcctcccaaagtgctgggattacaggcatgaaccatggtgcccagcctcatttttgaaatggaatagagaacagttatatcacagttgagagtttaatcaaaatgaccggatcagcatattctttttttagatgagacagagtttcgcccttgtcacccaggctgtagtgcggtggcgcgatctcggctcactgcaacctccgcctcccgggttcaagcaatgctcctgcctcagcctcccaagtagctgggattacaggcgtgtaccaccatacccagctaatttttgtatttttagtagagatggggtttcaccacgttggccacactggtctcaaactcctgacctcaggcgatccatctgcctcagcctgaaagtgctaggattacaggcgtgagccaccacacctggccagctcagcatattcttaagtaggattcacatttaattcttggtattataagttgcaaccatttgatttagaatgtatgcagctctcatgtttgtagtaataaagtttcatttttcctaagtaaaaaaaaaaacaacaaaaaaaaaaaaaaaaaactgagtaatcctagcgttaccttgtgccaatccttctcattagcgactactcggcttacatactgttcgtaaggttcctcgtcactcctggcaataccggtgcttaacccatcgtaatcgcctttctgaacttcctaatattttcagttgacgtttctgcgtggt

SEQ ID NO: 74024 - DNA, 4339 bp, Homo sapiens
cgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagttcctctactccagcagaaccttctttgttcacgtcctcaaagtcctatgttcggaggccacttgtccgacatcctcggagtccctcttctgggtcaccagttgccacctgcacagaccttgggggactgaacgaagggggcgaacattggaataaaagacaaagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatatagaaataattttgatcatgctccattacttccacaagaacagaaagcacacattagggaaaaagcttataaatgtaatgagcacggccaagtctttagagcatctgcaagccttactaaccaagtaatccataacgcagataatccttacaaatgcagtgaatgtggcaaggtctttagttgcagttcaaagcttgtgatacatcgaagaatgcatactggagagaagccttacaaatgtcatgaatgtggcaagctcttcagtagcaattcaaacctttcacaacatcaaagaattcatactggagagaagccttacaaatgtcatgaatgtgacaaggtctttcgaagcagttcaaagcttgcacaacatcaaagaattcatactggagagaagccttacaaatgtcatgaatgtgacaaggtcttcaatcaaattgcacaccttgtacgacatcaaaaaattcatactggagagaaaccttacagttgtaataaatgtggcaaggtctttagtcgccattcatatctagcagaacatcaaacggttcatactggtgagaaaccttacaaatgtgaagaatgtggcaaagcattttcagtgcgttccagcctcataacccatcagttaattcacactggaaggaaaccttacaaatgtaaagaatgtgacaaggtctttgggcgcaagtgtttcctgacctctcatcagagaattcatactagagagagaccttatggatgcagtcagtgtggcaagatctttagtcagaaatcagaccttatacgacatcgaaaaactcatactgatgagaagccttacaaatgtaataaatgtggcacagcgtttagagagttttcagaccttactgcccattttctaatccatagtggagagaaaccttatgaatgtaaagaatgtggcaaagtcttcaggtacaagtcttctctaaccagtcatcatagaattcatactggagagaagccttacaaatgtaacagatgtggcaaggtcttcagtcgcagttcaaacctggtatgccatcagaaaattcatacaggagaaaagccttacaaatgtaatcaatgtggcaaggtctttaatcaagcatcataccttacaagacatcaaataattcatactggagagaggccttacagatgtagtaaatgtggcaaagcatttcgagggtgttcaggccttactgcccatcttgcaatccatactgaaaagaaatctcatgagtgtaaagaatgtggcaagatcttcactcagaagtcttccctcaccaatcaccatagaattcacattggagagaaaccttacaaatgcaccctgtgcagtaaggtcttcagtcacaattctgaccttgcacagcatcagagagttcattcatgagagtccctacaaactgtgtatggcaaaaccatcatcatgagttctagcattaatcaacatcagtgagtccatactaagtggaaatcatataaatgaaatgtatgtgacacaggctttatcaaggcctgccaaatcactggacatcaccacatcactgtggaggatgaaagcacacagatgaattgtgtgtacttgggctattattcaaggaccattgctatagaacacgataggatttacacaagaagtaactctgtctctggttctctgatactaatctatgatattgcatgatgcagaataatgctaagtcaaaatatgttgaatctcatgacctgatgtatatcaaaggtgcaacggcttgtaaatgaccagttttattcaggctataaagcattcaattatttggggcttatagaaaaggctactttactctttgtgacttcgaaatcttttcatgtgccttccatacaggccattcactgtggtccctgggaaagaatcagtaggatgacagggctgacttcattagctgaggattatttctatccaatttcctgatgaaggacattgccttttgagattaaatattgtctgatttagagagcatggaggtgggcagagtaacataaaactgatgaccgtcatcatactgttgcagttagcacactttctcctgacataagtgcacagagcttcagtgtccaccaactgaccatgaaatagagtatgctgtaatcttaaggcataggttattagtgggaagagagtaataggttgctagtgtctgattatatggtagaaataatgcaaggaaaaaggtagccaccttctccattgaacagcagtacctgctgtttagcaaagactgatgagaagtagacttttttttttttggagatagagtctcactctgttgcccaggctggagtgtagtggtgtgttcttggctcactgcaccctccgcctcctgggctcaagcagtccttctgccttagcctcctaagtagctgagactacagacgtgcgccaccacacccagttcatttttgtatttttagtagaggcagtgtttaccatgttggccaggcaggtctccaactcctgacctcaagtgatatgttcacctcagcctcccaaagtgctgggattacaggcatgaaccatggtgcccagcctcatttttgaaatggaatagagaacagttatatcacagttgagagtttaatcaaaatgaccggatcagcatattctttttttagatgagacagagtttcgcccttgtcacccaggctgtagtgcggtggcgcgatctcggctcactgcaacctccgcctcccgggttcaagcaatgctcctgcctcagcctcccaagtagctgggattacaggcgtgtaccaccatacccagctaatttttgtatttttagtagagatggggtttcaccacgttggccacactggtctcaaactcctgacctcaggcgatccatctgcctcagcctgaaagtgctaggattacaggcgtgagccaccacacctggccagctcagcatattcttaagtaggattcacatttaattcttggtattataagttgcaaccatttgatttagaatgtatgcagctctcatgtttgtagtaataaagtttcatttttcctaagtaaaaaaaaaaacaacaaaaaaaaaaaaaaaaaactgagtaatcctagcgttaccttgtgccaatccttctcattagcgactactcggcttacatactgttcgtaaggttcctcgtcactcctggcaataccggtgcttaacccatcgtaatcgcctttctgaacttcctaatattttcagttgacgtttctgcgtggt

SEQ ID NO: 74025 - DNA, 948 bp, Homo sapiens
cgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacaggtgagagctcgggtgggcagagtggaggccccataatttttgttttttgagacagggtctaacgctgtcatccaggctagagtgcggtggcaatcatagctcactgcagccttgaattcctggacttaagggatctccctggctcgctcttccaaagtgttgggattacagccatgagccactgtaccctgcaaagccacactattacatagcgtttgggaaactctctgcaaatgggagaattctgtgggaaa

SEQ ID NO: 74026 - DNA, 1043 bp, Homo sapiens
cgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacaggctgatctcggctcactacagcctctgcctctctggtccaagtgattctcctgcctcggcctcctgagtagctgggattacaggcgcccatccccacccctggctgatttttgtatttttagtagaggcaggtttttgccatatttgccaggctgctctccaactcctgacctcaagtgatccacctgcctcggcctcccaaagtgctgggattacaggtgtgccactgtacctggcctgattgtgtcttttaaattgtaggaaagaattaaaagtcaagttacaaatgaaaagtgcaataatacttgtttctgtatttgatcatttgttgaccttttatgatgagctt

SEQ ID NO: 74027 - DNA, 1317 bp, Homo sapiens
caaatgtagacagaagggagaaaggaagaagagaaaatgaggcaaaactgagaggggaggggacagagaggtgacctgggcagagcttcacccatgaccctggaaagtgctcctgccctgggaggaggctcagcatggaaagaggaaggacagcagagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaagaaccagcatccagcgtgacctcaaggagcagcagccccaagcccttgcccctggccgtggtccctcccacagctctgccttctcgatgtcccctctctccactgcccaggcccccctacccaaccccaggacagcagcttccatctatgaggaattgctaaaacatgacacaaacatttactgccggatggaccacaaagcagaagtggcttcttagcttcctccaggagctgctcctgtgggttgatggagagtccccaaggcccccagccctggggatggggaaggacatgaagcctgagccagagaaccagctataagtcctgagaagacactggtgtctggggacagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 74028 - DNA, 1212 bp, Homo sapiens
caaatgtagacagaagggagaaaggaagaagagaaaatgaggcaaaactgagaggggaggggacagagaggtgacctgggcagagcttcacccatgaccctggaaagtgctcctgccctgggaggaggctcagcatggaaagaggaaggacagcagagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtataccaagaaaatgccccaggccttcctgtgggggccgtcgccggcatcgtgaccggggtcctggtcggagtggcgctggtggccgcgctggtgtgtttcctgctccttgccaaaactggaaggccgtggtccctcccacagctctgccttctcgatgtcccctctctccactgcccaggcccccctacccaaccccaggacagcagcttccatctatgagaagtggcttcttagcttcctccaggagctgctcctgtgggttgatggagagtccccaaggcccccagccctggggatggggaaggacatgaagcctgagccagagaaccagctataagtcctgagaagacactggtgtctggggacagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 74029 - DNA, 1824 bp, Homo sapiens
caaatgtagacagaagggagaaaggaagaagagaaaatgaggcaaaactgagaggggaggggacagagaggtgacctgggcagagcttcacccatgaccctggaaagtgctcctgccctgggaggaggctcagcatggaaagaggaaggacagcagagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtatacccggagctgcccaagccctccatctccagcaacaactccaaccccaaggaggacaaggatgctgtggccttcacctgtgaacctgagattcacagcacaacctgcctgtagtgggtaaatggtcagagcctcccggtcagttccaggctgcagctgtccaatgacaagaggaccctcactctactcagtgtcacaaggaatgacacaggaccctatgagtgtgaaataccgaacccagtgggtgccagctacagtgacccagtcacgctgaatgtcctctgtatcttctgttcctctgtggcccaggcttccagcccaaatccacacagccagaggccaggcctctcagtccctctcaagtccagggactcagactctcacccaggctggccatcacttcctgtcccaagcaaacctgggcagacccagccttgaccaagaataggaggggagaggctgctcctgtcctgggaggctcagggtccacagcctgtgatgggagaaacagaagaaaatgccccaggccttcctgtgggggccgtcgccggcatcgtgaccggggtcctggtcggagtggcgctggtggccgcgctggtgtgtttcctgctccttgccaaaactggaagaaccagcatccagcgtgacctcaaggagcagcagccccaagcccttgcccctggccgtggtccctcccacagctctgccttctcgatgtcccctctctccactgcccaggcccccctacccaaccccaggacagcagcttccatctatgaggaattgctaaaacatgacacaaacatttactgccggatggaccacaaagcagaagtggcttcttagcttcctccaggagctgctcctgtgggttgatggagagtccccaaggcccccagccctggggatggggaaggacatgaagcctgagccagagaaccagctataagtcctgagaagacactggtgtctggggacagggagggatgggggtccctgatgaatatctggagacctcgacagcctgccctaggccctgggtgggtcaggacaaaggcctctcatcaccgcagaaagcgggggcttgcagggaaagtgaatgggcctgtggcccacctggggtcacttggaaaggatctgaataaaggggacccttcctctc

SEQ ID NO: 74030 - DNA, 1413 bp, Homo sapiens
caaatgtagacagaagggagaaaggaagaagagaaaatgaggcaaaactgagaggggaggggacagagaggtgacctgggcagagcttcacccatgaccctggaaagtgctcctgccctgggaggaggctcagcatggaaagaggaaggacagcagagcctaagtcacagtagccctgactacagcattcctggagcccaggctcttttccacagaggaggaaagagcaggcagcagagaccatggggcccccctcagcctctccccacagagaatgcatcccctggcaggggcttctgctcacagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtatacccggagctgcccaagccctccatctccagcaacaactccaaccccaaggaggacaaggatgctgtggccttcacctgtgaacctgagattcacagcacaacctgcctgtagtgggtaaatggtcagagcctcccggtcagttccaggctgcagctgtccaatgacaagaggaccctcactctactcagtgtcacaaggaatgacacaggaccctatgagtgtgaaataccgaacccagtgggtgccagctacagtgacccagtcacgctgaatgtcctctgtatcttctgttcctctgtggcccaggcttccagcccaaatccacacagccagaggccaggcctctcagtccctctcaagtccagggactcagactctcacccaggctggccatcacttcctgtcccaagcaaacctgggcagacccagccttgaccaagaataggaggggagaggctgctcctgtcctgggaggctcagggtccacagcctgtgatgggagaaacaggtgaatatctcagacccagactcagtggacagattgggtttcgttaggacttcaaggttgtgacttggctcacagggacactgtggctcttccacagaccaggagcttccccttccctttgatgatatcatctatgactttattctcgctactccagatggaccgggcattcccaccatttcccccccatctactcttccaccaggacttagctcagtcttgatttttttcagggactcc

SEQ ID NO: 74031 - DNA, 1229 bp, Homo sapiens
cagacaagtctctgtgttcaaagagcttacactcttgcagagatgaagatagacacccaaagagatctagaatgtgagttcaggtgttgacaagagccctggagggaacagagcagaaaaagcctcacttctaaacttctggaacccgcccaccactgccaagctcactattgaatccatgccgctcagtgtcgcagaggggaaggaggtgcttctacttgtccacaatctgccccagcatctttttggctacagctggtacaaaggggaaagagtggatggcaacagtctaattgtaggatatgtaataggaactcaacaagctaccccaggggccgcatacagcggtcgagagacaatatacaccaatgcatccctgctgatccagaatgtcacccagaatgacataggattctacaccctacaagtcataaagtcagatcttgtgaatgaagaagcaactggacagttccatgtatacccggagctgcccaagccctccatctccagcaacaactccaaccccaaggaggacaaggatgctgtggccttcacctgtgaacctgagattcacagcacaacctgcctgtagtgggtaaatggtcagagcctcccggtcagttccaggctgcagctgtccaatgacaagaggaccctcactctactcagtgtcacaaggaatgacacaggaccctatgagtgtgaaataccgaacccagtgggtgccagctacagtgacccagtcacgctgaatgtcctctgtatcttctgttcctctgtggcccaggcttccagcccaaatccacacagccagaggccaggcctctcagtccctctcaagtccagggactcagactctcacccaggctggccatcacttcctgtcccaagcaaacctgggcagacccagccttgaccaagaataggaggggagaggctgctcctgtcctgggaggctcagggtccacagcctgtgatgggagaaacaggtgaatatctcagacccagactcagtggacagattgggtttcgttaggacttcaaggttgtgacttggctcacagggacactgtggctcttccacagaccaggagcttccccttccctttgatgatatcatctatgactttattctcgctactccagatggaccgggcattcccaccatttcccccccatctactcttccaccaggacttagctcagtcttgatttttttcagggactcc

SEQ ID NO: 74032 - DNA, 235 bp, Homo sapiens
cagccctggatgggcccagagcctgggagacgccacaccctgttctgaggagactagaggggtccaggcctcttctctgttttaacaggaattgctaaaacatgacacaaacatttactgccggatggaccacaaagcagaagtggcttcttagcttcctccaggagctgctcctgtgggttgatggagagtccccaaggcccccagccctggggatggggaaggacatgaagcc

SEQ ID NO: 74033 - DNA, 314 bp, Homo sapiens
aacctgggcagacccagccttgaccaagaataggaggggagaggctgctcctgtcctgggaggctcagggtccacagcctgtgatgggagaaacaggtgaatatctcagacccagactcagtggacagattgggtttcgttaggacttcaaggttgtgacttggctcacagggacactgtggctcttccacagaccaggagcttccccttccctttgatgatatcatctatgactttattctcgctactccagatggaccgggcattcccaccatttcccccccagactcctattaccatccaggggcaaatct

SEQ ID NO: 74034 - DNA, 514 bp, Homo sapiens
gctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttgctgctcaaagctaccaagcaagactgtgaaggcaaaaggaaaacagtctcaaaattaagtaacaatgtggagagtactatttggttttcctcagacacatatatatctgtacctataaagtgtggctttttaaaccgattctatgacagaattatcaaaagatcagaatggttgaggccgtcaagtcagttggccatatttgcaagccaacatcgacatcctgggcagcattcagcgctttgagggtacggggtgcctgtggacagcaggtccgtctgtgttgcctttttcaagccaccg

SEQ ID NO: 74035 - DNA, 923 bp, Homo sapiens
gcagaccaggacccacagaggcacttgagctgggccacaggcatgaactaagagtgctgaagacctaggagaaccactggtcaggtcagctcccagctccacagggagtaagaaggagctgcaggcacagcaggctgaaagtccaccaagggctgaggccacaaggctctggggcagccacagttttcatgatcacatcatacaggactgagaagcagataacaagagtgacgctcacagggctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacgggggtgctgaggaaattaaaacccgtcaatgcctcaaatgccaacgtgaagcagtgtctgtggtttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatctgcgccattcaagaaaactccaagctgaaaaggaaattaagctgcagctttttggtaggagcacttccctggaatggtgaattcactgtgatggagaaaaagtgtgaagatgcttaatggtgttttgaggcatccctccaacctctgtgactactttatccatgaaaatgaagcaatggcaggtgggaggctcttcccaatgtgctttcttcatgcatgcctctct

SEQ ID NO: 74036 - DNA, 765 bp, Homo sapiens
gcagaccaggacccacagaggcacttgagctgggccacaggcatgaactaagagtgctgaagacctaggagaaccactggtcagctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacgggggtgctgaggaaattaaaacccgtcaatgcctcaaatgccaacgtgaagcagtgtctgtggtttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatctgcgccattcaagaaaactccaagctgaaaaggaaattaagctgcagctttttggtaggagcacttccctggaatggtgaattcactgtgatggagaaaaagtgtgaagatgcttaatggtgttttgaggcatccctccaacctctgtgactactttatccatgaaaatgaagcaatggcaggtgggaggctcttcccaatgtgctttcttcatgcatgcctctct

SEQ ID NO: 74037 - DNA, 381 bp, Homo sapiens
tggtggggacaaaccatatccaaaccatagcaaagttgtctcttttctcatgctatgactgccatgcctccatagctttcttgcaatcctcttccccctccattctcggcagatgtgtcaggcacatttacatgttcacatctcctttcctacaaccctttttctttttcagaaaagtgaaacttttttctaattcatatttcaacagtcctccttccagtgctgtttctctatagagtgactgtcatttgcccctcctttcctgtgctctagagcttatgatacatggctttagtataaacatccctcatacatcactggctggtgctccacatatctttattcctccttgccaaaagcagcaggcgatgacaaggatca

SEQ ID NO: 74038 - DNA, 427 bp, Homo sapiens
aaataaataaacatcatagtttatggtgaaaaattaaaagcatttcctttaagattaagaagaagataagggggccagttactgttacaataggtagacaggcatgagcagggcagagggctcttcccttgcccactaggaatgtcgggtgatggtctggcagttttcatattgcctaagtgataaattggcagccggcttcagggaaaggccatttcctaatggtccacacctgttgtgctaaagtgttaattgaaggcagggaccagggagaagtaatttcttgagcatgtgcattaagagacaaaatggcggaatatgaccttctgggggcacaccaccagaaaagggaagaaaacctcagatgggcatgtctacaacttcctaaacacactgcgcctgctcacctcccaagggtaaggagggc

SEQ ID NO: 74039 - DNA, 264 bp, Homo sapiens
tgtgaacattgactttggctggcagtcgtggcttaggagagtgatttgtattatatgatgagaccaggaccactttcccagattgaattagaatctgtacccaatttttcttcctctctctgggtagagggtacctgagaccgattatagagctgctcttttcagtaggatagctgttacccaatgtgactgtctaaatgaaaatcaactaaaataaaaaaaaaattcagttcctcggttgtactagcaacacttcaagtactc

SEQ ID NO: 74040 - DNA, 514 bp, Homo sapiens
tttaaatatttggaattggttttataatgccttgaatttgtggctctttaaagtttatttgagaattacatactcttaaaaatttgttgaaagctatagacccttgctggcctccgaaaaatttgtatctatacataagacaattttgcatgcagttttcaggagattcacaaaccctctgaaatccacatacctcagaattagaactagtcttacacattatattggtttttgctgcagagcattgttgaagcattctattatctctggctgaagatggtatataccttccttggtagttgaatgttaactcagatggacgtgttcctctttcttctacacttacttttcttacctatgtacatttttttattaaaaatgcccatgtttatagagaggtctatttctgtatgtcttgtgtctgttgcattagtgtgtccaacttaaatattaagctcccagatgcagtgccagcatcttattatatgtaatgttcagaacagtgcaatgtcta

SEQ ID NO: 74041 - DNA, 483 bp, Homo sapiens
ggccttttttttgttgttattttggagaccttggagcagtgacccttcagatcactgtaggcagagaaatggcttctctcttatgctttcagttcagcatattaacaatgaggagccaggtacttctttactaccactttgtaccaagatttgataataatatatcccaggaggcattacttttataaatttgtattcatgtaaattttcaaatgagaacagcttctaaagccccttccctgtattggagagttatgtatatttctaataagtattagaaagaagctgtttctcatgccacagtgatgctgaaggattcacatttggtacaatcgagtaacttgaacgccagattgttaacagtttattctctttccctggatttttaagctcatcttgacacaggtgagtctatccaaatctttgatgttgctagtgtgccctgagataacgagggcacatctttcaatgttgattccaaaa

SEQ ID NO: 74042 - DNA, 1439 bp, Homo sapiens
  misc_feature (1)..(1): n is a, c, g, or t
  misc_feature (5)..(5): n is a, c, g, or t
  misc_feature (7)..(7): n is a, c, g, or t
  misc_feature (413)..(413): n is a, c, g, or t
ntttntntgttgggtaaatttgaaagccttgtcttcaagctgtgaagttctttcttctgcttgttctagtctattgttgcaactttccagtacattttgtatttctctaagtgtatctttgatttctagaagttgtgattggttttttctttatgatatctgtttctctggagaatttttatctatatcctgtatttaaaaaaaattttctctaagttggttttcaccttctctggtatttccttgagtagcttaataatcaacctgctgaattctttatttggcaattcagagatttcttcttggttttgatctcttgctggggagctagtgtgatcttttgggggtgttataaaaccatgatttgtcatactaccagaattacttttctgattccttctcatttggttacnctatttcctaaaatttttcttggatttatttttgaatggattgtggttttcgttttttgttttgtggttgttggtgagaatttgattcttggtgcttgtaggggtgaagactctgtatgagatccttagttagagagagtttttgtgtgctgaatttccccaatgctggttgtagtaattatatttttggtgtgtgggcaagttcactgtctcctatggagttggaatgggagggatctcctgaaacttatcttgttctcttgtgttgtacactttatttatttatttatttaattttttcctggtgttttatttactgaattgatgattcaggcttaaggccatcagggaggtaaccctggctatgcaacagttatgactaaggtgggtaggtagatgtaatatccaatgaagggccaaggtcccagccttgatgagggtggctgagggagctctgaattagatgtactggggttttatcaagatgaagagtgggagttacttcagttccttgccaggtcatcaagaaaactgttcacctcacagcctcactcctgtcttggtgtttcagctattcagattggacaggtacctcttttcatctgtaggtaggtaggaattgtgactcatgtaggcctgaatctggagtgtggtcctcctgtggggctgcactcactctggattgttccagaaatgctgtctataggtgcctccatgttgcattcctgttggggaagcctcagctgtgtctgcagtggagtgccagaggggaacaaggacctcttctcaaggcccttcatgatcacagagccacctgcctgttggggtataggttcagacttggggtataggtactgtacccagcactgcaattgtgtctctgctgtgaggaaatatccaccagtggaaaaaacaaaaactcaaggcctgctgattcttttgtcccatggggtagtccccttgatgtggtgctttctcctttcccctagggaagggccttcctgcgaactggactgcagtgattgt

SEQ ID NO: 74043 - DNA, 809 bp, Homo sapiens
tccaagactgggctccacgttcccagctttgcaggcgtctccttgggacactggtggtcgaatctaggagtaatgaccaggagatactgagtagtgacgacaacaacgatgttaatgataataaacgggtctcagtctttataattttggtggtccgtgtttgttggccgtttactttttatcagtcaccgagtgttgtagtgttgttttaccgctctgcaaaacgggcttgtcattggggacctctgatcattttacagatgtggaaacctagggattgaggaactttgccacagtcacacacaagtaatggcagagctgggattcaaattcggttctgcctcgtgtgagcgtccacgatataaatattatgctgcctttttagtcaaaagtagaattaggacctaattcaaacatactgaatgtctattgggtacttggcgctttttgcatagtgagggagacattgaagtccactttttgtagaaaaggaaacacacattttttgatccgctcaagtgtttggctttgggcaagttaacctgcctacctgtctgtgcctccgttttctcaaatatcaaatgaaccggtcgcctgctggcttccgcctgtaatcccagcacttagggaggcagagggaagaggagcccttgagcctaggaattcgagatcatcctggcaacacagtgagaccccgttctctacaaaaaaaagaaacaaaaatcaataaataaaatgagaccaattaaacgtatttcataggaaacttaaaaggtatgacacatatacatttacagtagcactattgg

SEQ ID NO: 74044 - DNA, 398 bp, Homo sapiens
atgcatcgcgtgtcgactgctaagtgatccccgaaacttaatagtgagggagacattgaagtccactttttgtagaaaaggaaacacacattttttgatccgctcaagtgtttggctttgggcaagttaacctgcctacctgtctgtgcctccgttttctcaaatatcaaatgaaccggtcgcctgctggcttccgcctgtaatcccagcacttagggaggcagagggaagaggagcccttgagcctaggaattcgagatcatcctggcaacacagtgagaccccgttctctacaaaaaaaagaaacaaaaatcaataaataaaatgagaccaattaaacgtatttcataggaaacttaaaaggtatgacacatatacatttacagtagcactattgg

SEQ ID NO: 74045 - DNA, 457 bp, Homo sapiens
actccagactcctccagctgtcatggatcctgggccaggggatcccgcactcacccaaagtggggctttgggcggtggtgggccggttcagtggtggagcgtctttttgtccagctcagaacctgctgccggtccggtcccagaaaagtttctagcgggtgtagttgccaaaattagggtctgtcactgctgggctggcggtgggcgcctcatcccagccttggaaatccttgcctagtagcgggaagttctaaacagcaaaggatacaaggccccttgagcgcaagtgaatttcccctcttgcagcaacaggtgtcctccaaaccaagcagcgtccacgtgtgtgcggtggctggagttctgcagtggggtgtggggattgggaaggtgcacaggcagccgcttgagacccagaggcagttggggagaggcctggggctcagagcctttcttgttt

SEQ ID NO: 74046 - DNA, 424 bp, Homo sapiens
aagaatcaaatcatcttgacaaaacttcaatgggcaaaatttgccttggggaattttatgcaggggaatccttgggtctgatgtgtggtgggctttggatgtgttgtgtagctcagtgtcccttcctgctactcctagtcatctccagaaactcagaccacccatctactaaaggcaggtggatgagcaagggggcctcggaggcattccggatcacactgaacctgagccccaccgcctgacccactcagtgtcactgttaacagaaactcgctgccatctggcctcaggcctgcctccttcctatagaacttgacactggaagcaccaggcgagctggaccttctgctgctactgcactcccatgatgcagcctgagaatgaagcccaccagagtgacagagagcagacctgagtggtgagc

SEQ ID NO: 74047 - DNA, 387 bp, Homo sapiens
tgagtttgcaaagcattccctttgccaggttaggttgcgtggactgacaccttagagattttcacagcctatccggtctgagtcccacggagagcagaactcacgtgctgtccttgtgcaaaccccatccagaaatcaagcgttatgctttccgtcctggactggagccagatccgttgtcttttactttctggagagagtgccccctccaaccaagatttaaaacaaacgaaaccccagcagtgtgaggctcggggtaggaggagatgcctttgagaacaaaaccataaagtctgtacataaacaatgcatacagactagcaaaaatcaaatgacttcccccaggcagcagggcttcaagagagcctggttaaatgttttcaccct

SEQ ID NO: 74048 - DNA, 350 bp, Homo sapiens
tttgcaatgccagaataacagtggatactcaataaattgaatagttaatccagattatgtttcctccaatttaagcttttctggttttttaaattcccccttcctagaatcagttttatcattttacctatgtacaataatatatttctggaaaatgctagaattttcaccatgtagtagaatttgagcacgacaataatgtaaaaaaattcagaagtctcaaactaggtagctttctttgagttttcaaagtaaatcaagatagagctgttttcattttactatattgtggaaatctatggatgttagtgtaaaatgcatgtgcattacactgacttaaaatgttttga

SEQ ID NO: 74049 - DNA, 150 bp, Homo sapiens
ggtttatccactgcagttctgttcacaccagaaaaagattggaaataatccaatgtttctcaagaaatagtttgtggtacaaagaatggaatactatgtcattttttaaaagcagtaagaaaaaatgtggtgttttctatgtatacgggg

SEQ ID NO: 74050 - DNA, 4911 bp, Homo sapiens
acctgcgtgcagtcggtcctccaggccacgcagcgcccgagagtaccagggagactccggcccctgtcggccgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcctcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccactttagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaa

SEQ ID NO: 74051 - DNA, 747 bp, Homo sapiens
tcagtcatctcccaccaggtccctcccgcaacgcgtgggaattatgggagctacaagatgagatttaggtggggacacagagccaaaccatattaaggggttacatcttcaagtggcttactgagtccttttgattaacctagtaggctttgcttagcttatttccttgtcttatttgacaagatgttccgtattcatcttgaatattttctgcctcagtcctggaatcagatgcttttataaggaatcctggttcattttagtgtgaattactcctaccaacctgggtactggaggttgtggtttttcttgggaagtccatatttctagaatgagtgtatttaaaaaggagctttgaaagactttatttctaaacaaattaatattgattaaaaagtatggttataactttttatcatacttctttaagttttaaaagacataaaaaggctaactttacattttatttgttgcatgtccttcccaaactgaatgaaaaaagtactaaactgacacctacaacattcctcttgtgtaggagtatacggaggagatagaacgtttaaaacgagatcttgctgcagcccgtgagaaaaatggagtgtatatttctgaagaaaattttaggtaagcccttggctatggagttaatttccaagaataagcatttctgataacaggctatttgaagtaaaacttatgtagcagtaagtaaaatctttatatccagtgccgataaatacttca

SEQ ID NO: 74052 - DNA, 5866 bp, Homo sapiens
  misc_feature (5865)..(5865): n is a, c, g, or t
acctgcgtgcagtcggtcctccaggccacgcagcgcccgagagtaccagggagactccggcccctgtcggccgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcctcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccactttagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaagaaggaggggcgcgcccccactaaaccacccgccgcgccgacggcgccacgatagacccacccccgccgatttttttcgagacaaaaggggccgccaccactgatcgcagtcggtcttttaataaaaccaccacaggcgcgccgccgccgctgtcaaccaaccagctccaagtgagacgggagaccaaagcaacgccaccgacggaccgatagtgagcagcaagcaccacaccatcggcggggggcgaacaaaactaacggacaccacacactacagcgaaaggaagcaaccaccccccagcggagagaggacacacacagcggaccagccgttagttcggaggcaaccacagaagtatgactaagacgaggcgtcagaaaacaacccttgccactcggaggcaagctctgactgaaaaccaatatacacccccgccgagggacctaataacaaaaacgcgagagcagacgcccgtacgcaccgaacaccaggcaagaacacaacgagcgacagcacacgcagccgaccagcgggcaacagacaacgcacaccaagccccaagaaagacatgaaaccagcgaacacaaacgacagagacgcccatcctgccacagcaacgacacaccaggacccaccccaccaagccagcagccaagacagtcagaggtaagcagcgcaatcccaagccgcgagagacacaaacagcactagaagcgcagcaggcgagaagcaccaacagcagacaacacacgcaaccataacaagagtaccggcgaacagacgcacacgccaagtacggtaacgcactagacaacaacaaaaaaccgaagctcacgggcagacacaaatgtcna

SEQ ID NO: 74053 - DNA, 4180 bp, Homo sapiens
tcagtcatctcccaccaggtccctcccgcaacgcgtgggaattatgggagctacaagatgagatttaggtggggacacagagccaaaccatattaaggggttacatcttcaagtggcttactgagtccttttgattaacctagtaggctttgcttagcttatttccttgtcttatttgacaagatgttccgtattcatcttgaatattttctgcctcagtcctggaatcagatgcttttataaggaatcctggttcattttagtgtgaattactcctaccaacctgggtactggaggttgtggtttttcttgggaagtccatatttctagaatgagtgtatttaaaaaggagctttgaaagactttatttctaaacaaattaatattgattaaaaagtatggttataactttttatcatacttctttaagttttaaaagacataaaaaggctaactttacattttatttgttgcatgtccttcccaaactgaatgaaaaaagtactaaactgacacctacaacattcctcttgtgtaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcctcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccactttagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaa

SEQ ID NO: 74054 - DNA, 3156 bp, Homo sapiens
cccccctccttaggggccaaccccccccccccccacaaaaaaaaaaaaaaaaaagaatggagaatggaaatgtaaattttaatgtgaatgtttagctaccaaagtatttaagatatcatttagaaaggtttacagaagtggaaatattctttttaaagacctatttgtttatttctgaaaccagaatgtactcaagactgatcttctaagttcactggaaatgattttatccccaactgtggtgtctatactgaaaatcaatagtcaactaaagcatattttcaagacttcattgacagtggccgataaggtaacaaatgctatgttcttaatatctcaaaattgatgtgttgtttaagaaggaaactcatttttgtttcttcaaagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcctcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccactttagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaa

SEQ ID NO: 74055 - DNA, 1204 bp, Homo sapiens
gtagtttcttctgaatgcttgcttatatagcatacaatggagggtgggctgttaaaatgaggcaataacctgtttcattcggggtcaatgtgttcaagaaagaaagcttgatatcctgtcaagtgtttatgaaatatattactgtgtttctaagacttcataaagaatctcagaagcttccagtttgaagcctgagattatggcttgagtttgtataagggacaaagaaaccagattatggttatttttcctttcactttgtgatgatttcaccagttacaacagctcttgctatgacttgtgtattttcttgcctcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccactttagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaa

SEQ ID NO: 74056 - DNA, 464 bp, Homo sapiens
attttaaactggataattctttgttgtgatgggctttcctgtggactgtactatgttggtacacaagaaaaacagtgtactatgtgaatactcactcaaagccagtagcactccctgattgtaacaccaaaaaagtctctcagcattgccaaatgtcccctgtggcagcagaatcactccctgatgagaaccactaccctggagtaaaatctataactatgtcttagaaaataacacagaaaattaatatttctttcactctactccttccattagtgatcaaataaagaaggcatttggcgctacttgccaaattgttggctcaaacttgtgctgaaccttttttggttttctacacttaagtttttttgcctataacccagagaactttgaaaatagagtgtagttaatgtgtatctaatgttactttgtattgacttaattttcccgccttaaatccacag

SEQ ID NO: 74057 - DNA, 910 bp, Homo sapiens
tgtgtgtgtgtgtgtgtgtgttgggaagagggaacattagacttatctgaaagtttagaaaatactacagaaagacacatccttattgattgacagatattctcctgcaaacactctgtcttctccccattgtgtagactctggaaagttattgtaattgttgatttcaggtcagcctctactctacctgcagcttggtctctggttttcaaattctgtagaaatttttacagctgtttgacttccttagacatgagacatgtactagatggcaatagcaggggacgtatcccctacactcctgtcctggtccaatgcctaacccatggggaacactcaatacatttatttgaactgaaatgaacctggttggtgggcgaggccgctaggggtagaggcagttggggaggaaggtggcagccatgtgcatgttggagatatgtgagtagctttaggtatctggaccccaaccagcccagtgaagagggtagagatgcaagacttgtagatatgacatcagagggtggcaaataatctgggtccctagcatgctgggcagcctgaggcgacggtccggtcagccaggctcagccaagcccctgagagcatctcgcaggaggtaccgttctgtccccagctgagaggcactaaggctttcccagcagaggttcagccctaccagagccgctcaggggaatgtgcagaaggaggacaagggaagcaactacctgacatcactctgccctgcttgtcaagacaaaacaacatgaatattaatttctcaggcataataaggtgtggaggagcaggagtgggcagggccattgtgtgggaggctgctccttcctgccatttgtcaccggcaggagtgatagatggttcttccaggcagcttcccaattagatggat

SEQ ID NO: 74058 - DNA, 792 bp, Homo sapiens
gactttcttttgtgataggtactagggatgcagagatgaataatacaaggtctcgaccttcaaggagctcagggtttagtagggaaaacagaggtataagtaagtcattgcaatgccaggtcccagatatgggaggattccagcaaagagaggataaggccaggcacagccgctcatgcctatagtcccaacactttgggaagctgagatgggaggatcacttaagcccagcagttcaaggctaccctgggcaacatagtgagtggcaaaaaatacaaaaattagccaggcagggtggcacatgcctgtggtcccagttatttgggagtttgaggtgggagaatcacctgagcctgggagattgaggctgcagtgagctgtgatcacgccactgcactccagcctgggtgacacagtgagaggtgagagcctgtatctaaaaaaaaaaaaaagagaggatcagatttacctggagaggtcagagaaggtttccagagggagtaaaacttgagcttcattttgaagaatgagaggggaatacaaggagggaaaaataataggaacaagacctgttcctgttacagcaaacctgtaactcccaccatggaatgggcacgttttcctgtagacatttggagccagtgtgggcttcaagcctagggggctgatatgatcatttgtcaatctgaagatgactcttggaacaacgtagaggatagggtgaggtgggtaggctggtggctgacagactaggtcaggagagggctgaccaagaggaggaggggtgacgag

SEQ ID NO: 74059 - DNA, 1408 bp, Homo sapiens
tacagacatgagctaccgtgcccagcctaggtatcgaattttcacaggtttcacagtccaggccctaccacccctgcagcaaataacttgatataaaacctgggcccaggctagtaatacccttgaagcccatgacagaagcaggcacagtgatagaagcaaaatcacgtagacattatcaatctagccccctccaattcctacccataaagcccactgaagatgaatttacaatcataaactacaaaacatgccaagaaagaaccacatgagggaagtcagcagatgtgtgaacagcaggaacggactccgccaccaaaggccttcaaaaggtgaatcaagcaaaaaagagaacattaattaaacatgtttaacatgggtaagaattacaggaataaaagaagtaaatgaacaagaatacgattgcaagggagtggtagaagaataggcagttttgaagaactaaatggaatatctagaatgaaaaaccatgcttgctaaaattaactcaatgagtgagtttaaaaagcaatttagacccagctgagagctgaatttgtggtatatgcagaaattacttctgatgcgaggcagagcatgatgacagaatgaggagatcccaaacatctatgagagttccattctgaatgattagaagaatgaggaagcaacagtatttaaaaagataatcactaagaaagttctatacttgatgaaaaatgtgaatcctaagattcaggaacagtgtgagacttcagctggggaaaaaagatgaaactacacttctacatttaggagtaaaactacagaatacaaaagacaaaaaaattttaaagtgaaaaataaaaccactcagattacatcaaaagcagttatcatgaaagcagcctatcaattacaatgataaaagccaagcaatagtcaaatatcgatttttttcaaagtcacaagataaaataagtagtaacataggattctgtacatagcattatttgttacctattggggcataacaaaattccccaaaactttgcagcttaaaaaacattcagtatttcaccattgccatgagtcaggaatccaggcgtggcttgagtcctctgcatattggcttctcaccagactgcaatcaggacaatagcacagtatctgtggtctcatctgaaggcttgcctgaggaagtctgcatccaagcttactcttcgttggctgttgggcagaggcaccctcagctcccagccatgtaggctttcccatggtgcagcttctatcaacaaagcacgccagacaagaggacaacacacagtcttctaggaagaagaaagccacaatctttttttaaaaagcaaagcaatatttatgtaattgccacttggtttgagaagtagaacactgtgtcaaaaacccc

SEQ ID NO: 74060 - DNA, 1162 bp, Homo sapiens
actacagagaaaaagctaagggtcatatggagagtgacttgggagaatggtcttaagggcacagggggcatggttgagaagaccttgctaatgcaaggtgacatttcagcagagacgcaaaggtatgaggaacaagctgtaggattatctggaagaagagaattttaaacagtacaaacaaaattctcaggagagactgtagctggcttgtgtaagaaacaacagggggccagtgcggctccagttgagtgaacagttgagagcatcttagaaactgaagtccaagaggtagtgagggaccagatcgtgcggggcttacaggtcctcataagacttgagtaagataggaagtcattggtgggttttgagcagcagaatgacatgaaagtgtgtatcttggcagcccagttggtaaacagttgttgtgtgatgaataagatattaatcaacacaggaatttggattttctgaggagatatttcatcctggcttccaaactgtttctgtttaacaataagaatactatcttttttccagtgaccaccataattctctcacatcacagaacattgtcctccttcctgtgaaaaagccccaccccctttcttgctatttggctttctgtttctaagacactatgaagacaatctagtctaagttaatactttttctcaccttagatgtaatctactagattacaacttagttttattctagggtatttttaattgactcttggatggttcaccatttctcgagtaggattccttctgcaggtctcatgattcattctgttttggtgagtttagcaacaaatttcaaatttaaatcctatatgcctccccaagcctctgcacatacatatacttggtgttgagtattagtactatttctagcttcaggtttgtcctaaaaatcatcagtctggaaaaacaatgcatttaaatattcattcctagccatgagaaaagtgctttttaactttggaggaaaatatactgtagcctttatataaaaatggctttaaaaaaagtttttgaggccaggtgcggtggttcatgtctgtattcccagcactttgggtggccaaggtcagggaccgcttgagcccaggagttcaagaccagctcaagcaacttggcaaaaccccatctctaccaaa

SEQ ID NO: 74061 - DNA, 1864 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatat

SEQ ID NO: 74062 - DNA, 673 bp, Homo sapiens
  misc_feature (2)..(2): n is a, c, g, or t
angggctaattctgcagagtttccaaaaccagaagacatcgtactaccaaagcccgttggcacctgcaggtattggcatcggtccctaaacccacggaagctgattgaagtgaagttctcccacctgagcagaaatatgaccatgcagcgcaccatgaagctctaccgactgccagagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaccttctgtcctggtattcctggtcagcaggtggcagtggaagaaatggagtgctggagcctaggctggagccaggacgacagggcttggacacaaagtccctcaagcccacagcaccaggccagcttccaaaggccttcctttaaggctgcccttcttccagggcaaacttggtgttgtcagacccttcc

SEQ ID NO: 74063 - DNA, 812 bp, Homo sapiens
cccggcctggacactgagtacatatgtgtacactctgagggacactgggcagaggccaggctggagggggcgctcagagtgtcctgagaaccacccggagagcggggattaacgtggaagcagcggagcttctgagggaaccttgttcttgtggctgcccacaggacagctttgaaatggcagcaaaggggtaggaaggaggctgtccccacctgtcctcacctgttcttgtttgtccctgctgctttgcagaaagggtttgatgtgttcaatgcactggatctcatggagaacaaaaccttcctggagaagctcaagtttggcataggggacggcaacctgcagtattacctttacaattggaaatgccccagcatgggggcagagaaggtaggcgacacatagccagagtccaggctgcccggcccagggtgtccatgtctccagcagaaaccgggccatgggttgaggagacagccgcagtctgggtccttgttacctcgagttgaacctttgaaaatgccctccctctgctggccagaccagcaggtcagcgttcccctctcagcaactggtgtgaggatggcagaggggacagagccacacagtagcacgaagatcatctccaatgaggccttcccacgtgagggaaccgtggaagttgagttgcccacggtttgccaggagggtagggctgggggaactctgaggaggtttcctctcctgagctgctgccctcttctggcatgacactttcttagcccttcctcccccagtgccataggggacataggggtgagcagtagcgtggg

SEQ ID NO: 74064 - DNA, 4896 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74065 - DNA, 5089 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaccttctgtcctggtattcctggtcagcaggtggcagtggaagaaatggagtgctggagcctaggctggagccaggacgacagggcttggacacaaagtccctcaagcccacagcaccaggccagcttccaaaggccttcctttaaggctgcccttcttccagggcaaacttggtgttgtcagacccttcc

SEQ ID NO: 74066 - DNA, 4891 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctgctttctttattagaaacaagtgagatgtattgagca

SEQ ID NO: 74067 - DNA, 4430 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74068 - DNA, 4886 bp, Homo sapiens
cgcagatgatggaagggaacgggaacggccatgagcactgcggcagcggaggtgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74069 - DNA, 4745 bp, Homo sapiens
ccaggtggtacgcctccgggtaacgggattgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74070 - DNA, 4994 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaaggttggagtgcagaagtacgaacatggctgaccgcagcctcaacctcctgggctcaagcaatcttcccacctcagcctcctgagtagccgggactacagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74071 - DNA, 4387 bp, Homo sapiens
  misc_feature (7)..(7): n is a, c, g, or t
ggtgttnatcgatgccacatagttctctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74072 - DNA, 4143 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccgggggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74073 - DNA, 3971 bp, Homo sapiens
acagctttgaaatggcagcaaaggggtaggaaggaggctgtccccacctgtcctcacctgttcttgtttgtccctgctgctttgcagaaagggtttgatgtgttcaatgcactggatctcatggagaacaaaaccttcctggagaaggtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74074 - DNA, 3785 bp, Homo sapiens
cccggcctggacactgagtacatatgtgtacactctgagggacactgggcagaggccaggctggagggggcgctcagagtgtcctgagaaccacccggagagcggggattaacgtggaagcagcggagcttctgagggaaccttgttcttgtggctgcccacaggacagctttgaaatggcagcaaaggggtaggaaggaggctgtccccacctgtcctcacctgttcttgtttgtccctgctgctttgcagaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74075 - DNA, 2513 bp, Homo sapiens
gaagaaaagtaagctaaagaagggaaacagaacctgcagaacactactacaagagagaagattctatacctctgacatagatcctctaatcttccactcgaagaatgaaatcctcttgtgatagagaaaggagttctcgttcttcctcattgtcatctcatcactcatcaaagagagactggtctaaatctgataaggatgtccagagctctttaacccattccagcagggacccactcgcgagtgggtccctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74076 - DNA, 2099 bp, Homo sapiens
tagacttagagaatcaccttgttcaagcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74077 - DNA, 1842 bp, Homo sapiens
agctcggtaccccttttggggtctctgctacaagaaagataagggatggcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74078 - DNA, 1297 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaacccgtctccacaggggaacctctagatcgaccatacagca

SEQ ID NO: 74079 - DNA, 1727 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagggccagtgctgccccgggtggtgggcagggggcagagagagggcaaggagagcctggctgtcagcaggagagaagggctctgggtggagagggagctttctcctactggaaaagcgaaccagcccatagtcttcagatttcctggactttctatttctgttatctgaagcaggattttattttagtttaactttctcagttcctctgagtctgtgcctggactagcttctctgccatctgttgaaaggctcagagaacacctattctctgtaattttagcctaagtaaagcataaatagaatgatgaatccacttagtgaaccttcatacacacggcagcgcgttccaaagcccagcgcagatgcactacagggtctgtgacgcccctctgccgggtcaggtaaagggtgacctgagcttgtgagggatccccgatttctaatcccaatttccccacccagatttggctgaaggactgggcaaccttaaagtgagctgcttttctgttctgggtctcagttttcctagtttcccaaagaaacaaatgctccaactgtggctggcttcaggtagggattcttttttttttgttttgagacggggtctcattctgttgcccaggctggagtgcagtggcacagtcacagctcactgcagcctcgacctcccacttcatgttaccaatctgaagtgggagcggtcc

SEQ ID NO: 74080 - DNA, 1135 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccaacagctacaaccggggtggtttgagtccagccaatgacactggagccaaaaagaagaaaaaga

SEQ ID NO: 74081 - DNA, 1265 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagggccagtgctgccccgggtggtgggcagggggcagagagagggcaaggagagcctggctgtcagcaggagagaagggctctgggtggagagggagctttctcctactggaaaagcgaaccagcctatcatccctccgagctgtcctagacgtctctatttacttgcctatccgaatcagcgacgtctagtttatgtttacctgatctcagttctctgagtcctgtgcctaactagcttctc

SEQ ID NO: 74082 - DNA, 1397 bp, Homo sapiens
aggatcccccatgccctcatccagtggtcttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74083 - DNA, 928 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagtcagacgagccgcgtagtcagatcgggccgcgtggtcagatcgagccgcgtagtcagatcgagccgcgtagtcagatcgagccgcgtagtcagatcgagccgcgtagtcagatcgagccgcgtagtccgatcgagccg

SEQ ID NO: 74084 - DNA, 840 bp, Homo sapiens
agctgattctagagtatccctcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74085 - DNA, 442 bp, Homo sapiens
catggccccgtggagcctgacaaggacaatatccgccaggagccctacaccctgccccagggcttcacctgggatgctttggacctgggcgatcgtggtgtggtgagtgggccctcagaaggttacacctgcgggtaggagccactttcacagtaagccctgcagtctcacctagactacgtttactcgagccctagagagctgagccaaggaggtctgaacagactcccgtctgtaacttcctggggcatggccaagactccacataaatagctcttagcttttctggcaggttggaagttaacctctgtaggtccccgatgtggatacctgtttttcatttattcttttttgttcattcatttcctcattttctttctagtctgtctcctgactggagcagctggggctgctaaatgaggccctgtcctcccctttccac

SEQ ID NO: 74086 - DNA, 4836 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74087 - DNA, 4644 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaatagatatggatgtttactggaatgtcctttggtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74088 - DNA, 5500 bp, Homo sapiens
tgcctcgtcctcctgagtagctgggactacaggcatgtgccaccaggccccagctaatgtttatatttttagtagaaacagggttttgccatgttggccagtctggccttaaactcctgacctcaagtgatccacctgcctcggcctcccaaagtgttgggattacaggtgtgagctaccacgcctggctgatttgggcatttctcatgactgaccattttggacacagattgtggcaatgttaatgtgcctttttcctcatccctcactcccttttcatactgtcttgtgctccagatccagctggggaaaatcatgaaacctaatacatttgggaggtggaggaaggaagggcaaagcattccagaaagcccatcactgccttttggctgtcatccttttacattcagagttcaaggaagtattgtagtatgaatgccttgttaacaattatcattcgtctttggtgccattaccctggcaatataaagaaaataagcaacataaaagcaagaacggaaaaggccctttcacacaaataggacatcccttgcccagcactccctccctgaaagccgagggggcgcgagtcaggaggagtgctggtgtcctccaaatgccctttctggacctgggttcttcagcctgcttctgaaaccaacaggcttgattaaggaaggtctggctccacagaaagctctttgtcaggggtagcacaaaacagattttttttaaaccctgcattagtatttactttttgttacagtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74089 - DNA, 4787 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74090 - DNA, 3751 bp, Homo sapiens
  misc_feature (3705)..(3706): n is a, c, g, or t
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaanntcagagaacaccgctatgcatgtgttctgagttcgcgcgcggggt

SEQ ID NO: 74091 - DNA, 3982 bp, Homo sapiens
gagccgccgaatgaccagggattctctcttgagggcctgatctgtccttgccatggatagatccagggtgatcagctcatctcactccatctcttctgtcttgcctccagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatctagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtggccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccatcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactccggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaaca

SEQ ID NO: 74092 - DNA, 2289 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaccttctgtcctggtattcctggtcagcaggtggcagtggaagaaatggagtgctggagcctaggctggagccaggacgacagggcttggacacaaagtccctcaagcccacagcaccaggccagcttccaaaggccttcctttaaggctgcccttcttccagggcaaacttggtgttgtcagacccttcc

SEQ ID NO: 74093 - DNA, 1923 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatgaaagggtttgatgtgttcaatgcactggatctcatggagaacaaaaccttcctggagaagctcaagtttggcataggggacggcaacctgcagtattacctttacaattggaaatgccccagcatgggggcagagaaggtaggcgacacatagccagagtccaggctgcccggcccagggtgtccatgtctccagcagaaaccgggccatgggttgaggagacagccgcagtctgggtccttgttacctcgagttgaacctttgaaaatgccctccctctgctggccagaccagcaggtcagcgttcccctctcagcaactggtgtgaggatggcagaggggacagagccacacagtagcacgaagatcatctccaatgaggccttcccacgtgagggaaccgtggaagttgagttgcccacggtttgccaggagggtagggctgggggaactctgaggaggtttcctctcctgagctgctgccctcttctggcatgacactttcttagcccttcctcccccagtgccataggggacataggggtgagcagtagcgtggg

SEQ ID NO: 74094 - DNA, 1789 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagggccagtgctgccccgggtggtgggcagggggcagagagagggcaaggagagcctggctgtcagcaggagagaagggctctgggtggagagggagctttctcctactggaaaagcgaaccagcccatagtcttcagatttcctggactttctatttctgttatctgaagcaggattttattttagtttaactttctcagttcctctgagtctgtgcctggactagcttctctgccatctgttgaaaggctcagagaacacctattctctgtaattttagcctaagtaaagcataaatagaatgatgaatccacttagtgaaccttcatacacacggcagcgcgttccaaagcccagcgcagatgcactacagggtctgtgacgcccctctgccgggtcaggtaaagggtgacctgagcttgtgagggatccccgatttctaatcccaatttccccacccagatttggctgaaggactgggcaaccttaaagtgagctgcttttctgttctgggtctcagttttcctagtttcccaaagaaacaaatgctccaactgtggctggcttcaggtagggattcttttttttttgttttgagacggggtctcattctgttgcccaggctggagtgcagtggcacagtcacagctcactgcagcctcgacctcccagactcaactgattctcccacctcagcctcccaagtagctgggactacaggcgtgtgccgccatgcccggccaatttttgtttttatagaaacggg

SEQ ID NO: 74095 - DNA, 1083 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtattggcatcggtccctaaacccacggaagctgattgaagtgaagttctcccacctgagcagaaatatgaccatgcagcgcaccatgaagctctaccgactgccagagactcccaagacagctggactgtgaccaggcgtaggggatcctgcagagacgaccgcagc

SEQ ID NO: 74096 - DNA, 1261 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacacagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtaaaactgtcttcctgtaagtccccgaaaatgcgggtgtctgcactgtagttgaggagcatgtgccactgtgagtcacagctccgcccttagcatcccacctctggcgtatctggtaaggcgggcacttggtgcctgcaggagccagatggggagcatggagagggcgggagggttgtagggatggcagattggcaagtccctgccttgtctggagggctcttggtgtctgctggctgctgtccatttggagatggtggggggcggtactggtggtttgtttctctcgtccctctagggatgagccccatatctgatattattatgggttatgtctgtaaagatc

SEQ ID NO: 74097 - DNA, 777 bp, Homo sapiens
agcggggggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactggagccaaaaagaagaaaaagaaacaaaaaaagaagaaagaaaaaggcagtgagacagattcagcccaggatcagcctgtgaagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggcgaagtggtgaacacccatggccccgtggagcctgacaaggacaatatccgccaggagccctacaccctgccccagggcttcacctgggatgctttggacctgggcgatcgtggtgtgctaaaagaactgtacaccctcctgaatgagaactatgtggaagatgatgacaacatgttccgatttgattattccccggagtttcttttgtgggctctccggccacccggctggctcccccagtggcactgtggggttcgagtggtctcaagtcggaaattggttgggttcattagcgccatcccagcaaacatccatatctatgacactgatgacacatatgtcgggtgatcctctagagt

SEQ ID NO: 74098 - DNA, 195 bp, Homo sapiens
tgccatgaaatggaaatactaattcaagttttccaccaggctggatatgctcataggaaaataatcctttttgctcttatgagatagaggcgttgaaaatagaacctgtaaagttgagaaatgcagtcgtgttttcagttgtctacattgagcatttattacctttataataaaaaatatggtttaggctgcgca

SEQ ID NO: 74099 - DNA, 424 bp, Homo sapiens
cctgggtttggatttgtattgtgaggaagaggagacagagtggggtgtgtcacaaaggctgagatgagcaggaaatcaagccttgctagttggttttctggagtggaattgagccttaagaaatgagatttgtgagggccaggtgtggtggctcatgcctgtaatcccggtgctttgggagaccaggtgggaggctagcttgaggccgagagaccagcctgggtaacatagcaagacccagtctctacaaaaaataaaaagatgagctgggtgtgttggtgcatgcctgcggtcccagctactcaggagtctgaggtgggaggatctctggggtccttgggatgcccccctacccccacatctagcgggctttggccactgcactccagcctgggtgatagagcaaggtcctatctctaagaaa

SEQ ID NO: 74100 - DNA, 352 bp, Homo sapiens
ctgtgacttgcgcgtatacgcccagatggcctgaagtaactgaagaatcacaaaagaagtgaaaaggccctgccccgccttaactgatgacattccaccattgtgatttgttcctgccccaccttaactgagtgattaaccctgtaaatttccttcttctggctcagaagctcccgcactgagcaccttgtgacccccgcccctgcccaccagagaacaaccccctttgcatgtaattttccattaccttcccaaatcctataaaacggccccatccctactccctttgctgactctcttttcggactcatccggcctgcacccaggtgaaataaacagccatgttgctcac

SEQ ID NO: 74101 - DNA, 1102 bp, Homo sapiens
gccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctgaaatgaggtcttactgtgttgcccaggctggtatcaaactccagtgatcaagtggtcctcctacctcagcctcccaaacagatatgacagctgcatagattcaacctactatgaaaagccaaaacatggaatattacactaattaaacggttacacaacagaacatggaatgtgcgacacttcatcttgggatgcaaatttttgtgctaaaaaaaactgagaaaaacaaaaagaaaaacatgtatttctgaggaacttgtttttatatctggcataaatgagaaaaagctaattaaaactattaattatcagaaaattgaagataaagttgaagagcctataccaaccaaagttgaataaatggcaaaatataatatagatgagttactctgaaataattttttatttcctactatctaacttaccaaacttcctgattttaattacataacaattttttggttattttaatattcatttggtacttatttccttttttattgttatagtattagatgaaatcataacatcaatttgctcctttgtaaaagaggatgttgagttagaagtgttctaaggtggctttcagcaataggctgccataccaattggaaaaatctagcatggtataaaagaatatttaagcagtaattatgactggaaaacatcagagtggaaatgaagtatggctgagaaacctttttgcttttagctttttttggagttcattacaataaaatgaaattatagaaactta

SEQ ID NO: 74102 - DNA, 743 bp, Homo sapiens
ggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacagatggggtggctggacgagagcagctcttggctcagcaaagaatgcacagtatgatcagctcagaggagtgggacccatgactgagctgggaaggcaggatacctaaacctgctcaagtttctattgggaagaaccaagaagcaggaggaatagatgttagctaggcactagcagtatttgctacaacgtggatattgttgaactatgggtgttgactttcttttcatgaagataatatatctgtttaaatactaatgggaaagaagctttcagaagatcattaaatgcattaaaacctgcagatgtccacatgtctgtgcctctctttagcagcctgactcctttgggtcagttattcttagcctcggtatttctatcttatggcatcgcaggtctaagattagcttgttaggcgttatcatgccatatgagttacctcctaatataactctacactggaatgat

SEQ ID NO: 74103 - DNA, 4354 bp, Homo sapiens
  misc_feature (4257)..(4257): n is a, c, g, or t
ggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaccccaatccaccnccaacaaaaataaaaaaacccgcacgagcttcccggtgccctgagcttggcggcttgcattcgcccggggggagggaaggcaactcgaggataggca

SEQ ID NO: 74104 - DNA, 3564 bp, Homo sapiens
gccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctggagtacctggtaaaatgctgtggtgtatggagacagttatgagaaactggagggaggatgatagttgagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacatttatttagagtta

SEQ ID NO: 74105 - DNA, 3325 bp, Homo sapiens
ggggaagagaggcacagacacagataggagaagggcaccggctggagccacttgcaggactgagggtttttgcaacaaaaccctagcagcctgaagaactctaagccagtttccgggataacctaaactccagagagctatagcatccactctgtcctttctgctttgcacacagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacatttatttagagtta

SEQ ID NO: 74106 - DNA, 4294 bp, Homo sapiens
  misc_feature (4197)..(4197): n is a, c, g, or t
gccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctggagtacctggtaaaatgctgtggtgtatggagacagttatgagaaactggagggaggatgatagttgagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaccccaatccaccnccaacaaaaataaaaaaacccgcacgagcttcccggtgccctgagcttggcggcttgcattcgcccggggggagggaaggcaactcgaggataggca

SEQ ID NO: 74107 - DNA, 4048 bp, Homo sapiens
  misc_feature (3951)..(3951): n is a, c, g, or t
ggggaagagaggcacagacacagataggagaagggcaccggctggagccacttgcaggactgagggtttttgcaacaaaaccctagcagcctgaagaactctaagccagatggggtggctggacgagagcagctcttggctcagcaaagaatgcacagtatgatcagctcagttgaactatgggtgttgactttcttttcatgaagataatatatctgtttaaatactaattggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaccccaatccaccnccaacaaaaataaaaaaacccgcacgagcttcccggtgccctgagcttggcggcttgcattcgcccggggggagggaaggcaactcgaggataggca

SEQ ID NO: 74108 - DNA, 3936 bp, Homo sapiens
  misc_feature (3839)..(3839): n is a, c, g, or t
gtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaccccaatccaccnccaacaaaaataaaaaaacccgcacgagcttcccggtgccctgagcttggcggcttgcattcgcccggggggagggaaggcaactcgaggataggca

SEQ ID NO: 74109 - DNA, 4301 bp, Homo sapiens
  misc_feature (4204)..(4204): n is a, c, g, or t
gtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaccccaatccaccnccaacaaaaataaaaaaacccgcacgagcttcccggtgccctgagcttggcggcttgcattcgcccggggggagggaaggcaactcgaggataggca

SEQ ID NO: 74110 - DNA, 3095 bp, Homo sapiens
gccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctggagtacctggtaaaatgctgtggtgtatggagacagttatgagaaactggagggaggatgatagttgagatggggtggctggacgagagcagctcttggctcagcaaagaatgcacagtatgatcagctcagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttcggtttatttctttagagccccacttttatttgtatctttcaggtaattgcattgcatga

SEQ ID NO: 74111 - DNA, 3208 bp, Homo sapiens
  misc_feature (3111)..(3111): n is a, c, g, or t
ctcggtacccggcaagctatccggttcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaactgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagaaaaaaccccaatccaccnccaacaaaaataaaaaaacccgcacgagcttcccggtgccctgagcttggcggcttgcattcgcccggggggagggaaggcaactcgaggataggca

SEQ ID NO: 74112 - DNA, 2942 bp, Homo sapiens
gtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaacctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaatgttttggtcatttgacgaagcaattgatgacattggctgatggacgtgtggtgttggctctagaaggaggacatgatctcacagccatctgtgatgcatcagaagcctgtgtaaatgcccttctaggaaatgagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacatttatttagagtta

SEQ ID NO: 74113 - DNA, 2724 bp, Homo sapiens
gtgggagaaccaggggaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagggcagtggcaagtacagaagtaaagcagaagcttcaagagttcctactgagtaaatcagcaacgaaagacactccaactaatggaaaaaatcattccgtgagccgccatcccaagctctggtacacggctgcccaccacacatcattggatcaaagctctccaccccttagtggaacatctccatcctacaagtacacattaccaggagcacaagatgcaaaggatgatttcccccttcgaaaaactgcctctgagcccaacttgaaggtgcggtccaggttaaaacagaaagtggcagagaggagaagcagccccttactcaggcggaaggatggaaatgttgtcacttcattcaagaagcgaatgtttgaggtgacagaatcctcagtcagtagcagttctccaggctctggtcccagttcaccaaacaatgggccaactggaagtgttactgaaaatgagacttcggttttgccccctacccctcatgccgagcaaatggtttcacagcaacgcattctaattcatgaagattccatgaacctgctaagtctttatacctctccttctttgcccaacattaccttggggcttcccgcagtgccatcccagctcaatgcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaacctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggaattgcctatgaccccttgatgctgaaacaccagtgcgtttgtggcaattccaccacccaccctgagcatgctggacgaatacagagtatctggtcacgactgcaagaaactgggctgctaaataaatgtgagcgaattcaaggtcgaaaagccagcctggaggaaatacagcttgttcattctgaacatcactcactgttgtatggcaccaaccccctggacggacagaagctggaccccaggatactcctaggtgatgactctcaaaagtttttttcctcattaccttgtggtggacttggggtggacagtgacaccatttggaatgagctacactcgtccggtgctgcacgcatggctgttggctgtgtcatcgagctggcttccaaagtggcctcaggagagctgaagaatgggtttgctgttgtgaggccccctggccatcacgctgaagaatccacagccatggggttctgcttttttaattcagttgcaattaccgccaaatacttgagagaccaactaaatataagcaagatattgattgtagatctggatgttcaccatggaaacggtacccagcaggccttttatgctgaccccagcatcctgtacatttcactccatcgctatgatgaagggaactttttccctggcagtggagccccaaatgaggttggaacaggccttggagaagggtacaatataaatattgcctggacaggtggccttgatcctcccatgggagatgttgagtaccttgaagcattcaggaccatcgtgaagcctgtggccaaagagtttgatccagacatggtcttagtatctgctggatttgatgcattggaaggccacacccctcctctaggagggtacaaagtgacggcaaaataaactcctgtgctggaggtacaacagtttggaagtatacttggggaaagagaaaacacaagatggaaggaagatctctcttttcacatcgggagcac

SEQ ID NO: 74114 - DNA, 1021 bp, Homo sapiens
gccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtttctcctctgccaacccctcctggaccattgtcagcagttgaacgacaaaggctgtgaatctgcatcctagtcttagcagtccctctgattctcatgatgagctcacctgcacagcctgatatgacagctgcatagattcaacctactatgaaaagccaaaacatggaatattacactaattaaacggttacacaacagaacatggaatgtgcgacacttcatcttgggatgcaaatttttgtgctaaaaaaaactgagaaaaacaaaaagaaaaacatgtatttctgaggaacttgtttttatatctggcataaatgagaaaaagctaattaaaactattaattatcagaaaattgaagataaagttgaagagcctataccaaccaaagttgaataaatggcaaaatataatatagatgagttactctgaaataattttttatttcctactatctaacttaccaaacttcctgattttaattacataacaattttttggttattttaatattcatttggtacttatttccttttttattgttatagtattagatgaaatcataacatcaatttgctcctttgtaaaagaggatgttgagttagaagtgttctaaggtggctttcagcaataggctgccataccaattggaaaaatctagcatggtataaaagaatatttaagcagtaattatgactggaaaacatcagagtggaaatgaagtatggctgagaaacctttttgcttttagctttttttggagttcattacaataaaatgaaattatagaaactta

SEQ ID NO: 74115 - DNA, 1538 bp, Homo sapiens
taggaccctgtctcaaaaaaaaaaaaaaaagtttgatgctcattatgtttacaaaagcactgcattttttgaaaagtgtctcactgtgctattagctcatttcttgagatgtggttcttaggaaagagaagccttagtaacttagtttagagatggcttgggcactcgggagattttttcaatttcctgtggctatggagtgcaggagaatgatgccattaactaccagacccttgaggtcagcacagctctggcatcttcctgcaggcagaaccgtatactcctgaggatttgaatgctgtcctactgctgactcaaaggctaatcaatgcatgtgttaaactgcatggacatttagcagacatggtgatctgtatatagccatgccttatagtccacagtggagcatacatttcctgagagcgtaaatcagcattcgcctcctcctcctcctcttccttctcttctccctctctcctttctcgtcttcagtagttattgagcattcacctcagtgtcaggcaccatgagtactttcatgcatcatctcatttgatccctgcaacttcactagaatgtcagttccactgatgacagtgtattcagaattaattttctttaaggaaaacaaaaaggaatttcttgaggggctttctactgtccagtactcagtgaatatctgttgaattaatatactccaatcccatgagttagatatgattagtgatgagggacctgggattgagacattagtctaatgacactacattctagaccctgttgctaagcacttcttgtattgcatatcaactcatttactcctcacagcaatgtgagatacatactgtcctccctgttttataattgagggaactgaagcatagacaggttacatagctggtgactggcagatgaagtgacttatccgtggtcctgcaggtgatgagtggcagtactgtgctcttatcaccagctcttgagcgtgctgcatcctctcatttgtcgttggtctcccctagtgttcggtactgtgccttgcacgtgtttatactcagtagcttttgaatgaaagacagacttacattgcaaatacaacagatttccgtgtcttattagaaactgcttttcttgaattactacatgtaacttttaaatgaaagattggtgaatatttccagatgttgaaatacaaaaacaggtggctgaacttagaaaccaccaagtggcaggtgactttgcctgacatccgtgttcacagacctccacagcccctggtgaaaaccacttcttcatatcccatgtccgtctaattacatgtgttattttttgtcatttgcagagtcaacggttgcaggaaagtttgaagaaagtgaattacatcaaaatcttggtatagtatataatttcatctgttttcaaaatataactttttttgaacttcagcaacttagaatgattttagaactttagaatgattttctccacatttcagtggaattgtggcagctccagtaaaaaacaaaacaaaaaacaaaaac

SEQ ID NO: 74116 - DNA, 1177 bp, Homo sapiens
gaaaaatacgtaaatttatacctagaaaatatctgaaaggttatgtattaaactgttaacggggtggattggtggcttatagggtagggggctaggcattttcacttctaatacctgtgtttttttttgaggatttgttttacttgggtgtcacattcataatttttaatcctttaaggagaaaaatgtgcttattaaatttttggtctctgaatgctaccaagtcttagtcatacagaacaatatgctgcaactgtttacaattcctaaaactgtaaactcctcaaggacttggaggctaaacatgaagaatataaaattaagttgacaatcactgtctcctgcataacactgacttcacttctcttgagaaatgtgcatctgctaatccatatttattactttttaggggtgggtgaacccataaataagatactgttctttgaatgcctttagctggtgttatttaccagtaatgcttggagaaagaatccaaaattacccccactaaaatgctcacgacccagttgtttctgtgtttgtcaaagtgtttctggtatattctagaatataccaaagataattacttgaatcatttagaaaattttacattatatcctcttataaggcacttggaaattcaccctttttttttttcggcttggctttctaaatgtactttaacatcaatttataatattaagagttcctaaggagagagatttcttagaagaataatcgtggcttgtcttagagccacagcctttcacaatctgaagtgaatggtgcagagagctttcttgtcaagtcgtatgtttcttcctgcagctcggcttgcccttcccctgcttgtgccgtgtaccctgtaacactgtgtttggatcccagcatcagatggtgagttctacttttggtttgtaaaatcatgtgggattgtgtttggaaactgcctttcaagtgaagttctttttgctggcctccagataattagtaacttactgatgtattgcttggacccttgcattgtgtaatatatgcttctgttaatatgtgaatgtccatgaaggttggttggtatataggtcaggagcacctggcttttaaggagtcttgtaattactgtatcgcctgctttaagtagaaacatggcagctcaattaagcaccagaaatttctt

SEQ ID NO: 74117 - DNA, 682 bp, Homo sapiens
atactaggcacctcattttttaatgatttgttttggttccaggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtatagtatataatttcatctgttttcaaaatataactttttttgaacttcagcaacttagaatgattttagaactttagaatgattttctccacatttcagtggaattgtggcagctccagtaaaaaacaaaacaaaaaacaaaaac

SEQ ID NO: 74118 - DNA, 759 bp, Homo sapiens
ctagcccacactaagtgggtagcaaatggtagctggttagttctattatgagattgcaatggctttgattaataaacctcttttggcttttttagactttagttgctggtcttacatcaaataagcccacagacaaactccgtgccctgcctctgtggttatctttacaatacttgggacttgatgggtttgtggagaggatcaagcatgcctgtcaactggtgagtagaagcctgacatttaaatgaaagactccttggccacagcagagacagaaaaacatctcatttctgtaccttccatccagagtggtgttgtctggattgactgtctcgtgagccagagactaatcgccctgcatgtaaatatttcttgttcaaagttctgggagaaagtgctgggttgtctgtcccagcatttgtgtgcagatgaaatcagatgaaaaggaacaccactgtcagcatgggatcagaaaagaagtcacagatgacttccaaggagtggagaagggtgcaaaaggtggaggggtggggagcgagtgttccccttgattgactgactacggtgagggaataggaaggttacaaggtggttatggagggcatggatattttaaaaaccagctggcttgggtttccaaattgcagggctcttggggacaattctaattctctctccattttaggtgtgttctaattgtgaaaaatatataattatgctatatttcagtgttttagagcattcagccttctataacaa

SEQ ID NO: 74119 - DNA, 1368 bp, Homo sapiens
gccgtgtacccaaggtcccttagcctctgagtagtggggaccacagcacataccaccacagccaggtaatttgtgtagtatttgtaaagacaggtctcactatgtgcctaggctggttttgcactcctggccgcaagcaatcctcctgtctcagcctcccatagcacagaagttacaggaatatgaaccacatctggccagcaccaagtattttgacaaagcacctattagggtaattccaagtaatctctggcaaacatggtttcagttaggcaagactacaagaaaccgcccacatctatttggtaaaaatctgtgctcccctttcctacttgagtagacacgctcacaaacagacacaaaggcagacccctccctctagtttttctaacataccagagccccctgcaaacacccgaggccctcaatgctgattttcactggaatctcatcacagttgggcttaagggacccttgggccaaggtcccttaagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcaggtatgatctcgtgaaaccttgagagaaactgaatgaggaatgaaactattgttcctgtttcacacagaagaaaactgaggttggcactcatgatgagcccctgttctcattctgcaaatggtgaagctctctatcgtcctgaccccacagttcctgtcccatgaccagggcccgctcaccaaggagctgcagcagcacgtaaagtcagtgacatgcccatgcgagtacctgaggaagacgatcctacacctgccacctccgatggatccactgcctctgtgcctgcctgtactgccgatgcttcagtggataactcagcatcccagccaaggcccaatgccactgaagatggacctgccccctggggacccaggagtcctaccactcagctgtccccaggagtgcccagaccctcattcttatccaggacctaggagccttacccctggccttccctcatcagccgta

SEQ ID NO: 74120 - DNA, 647 bp, Homo sapiens
gcctactactactactaaattcgcggccgcgtcgacaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcccgcccctactaaaaatacaaaaaattagccaggcaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggtggcatgcgcctggggtcccaagtactcgggaggtagaggagagaaaaatcacttgagcccagagagg

SEQ ID NO: 74121 - DNA, 624 bp, Homo sapiens
cgggtctagaggagtccccatacatgctcgacattgctcaaataagaagctatatttcattgagttacatatgatattaaagcaatcctttttattttcagaaagacatttatattaatatatattttgtgaaatgaaggcatttattgaaattagatcccatagtttttatggtatcatgccttagagaggcgctggcagaaggactgaagagtgagtgtcgcatgtctttctgctgctgtgcttctgcttcctaagaattgctgtacttgtattcattaggtatttagttagttttctctttaattattttaaatttaatgttttgaaataagtaaaattgttctcttggttcaaaattcagacaataaaaaacgatatacaaagggaattttccttcctacctctatctccctaccgtgttttcttctctagagacagacattaccagtttcttgtgtattcttccagagagattttatatgtattatacaccagcaaaatgtctatgcccaccctctctaatacataattactacgcatatgctgtgcatcttgcattttttcacttatgtcttggagttcactgcatattaatgcacaggaactttctcctttgtcaga

SEQ ID NO: 74122 - DNA, 460 bp, Homo sapiens
atactaggcacctcattttttaatgatttgttttggttccaggatgttgccttcctggagaaactgattaaagatgatatagagcgaggaagactgcccctgttgcttgtcgcaaatgcaggtaggtagcatgatgctgaatctaccattttgaatatataggagcgaggctacatcctcagcctataaaagataaagtcttaagaaatgtgtgtgtaccacatgtttaattaagatagtccatgtccacattgtagcaaaaactgtaatagtaaggttggctcgttagatttttctttaatcgttggtttgttttggaagttattttatgtgtgtgtatactttttcatttagattgtaaatgcttctctatcttctccttcatgtacttcttttccctgttctaaactgaattttattttatttttttgagacagagtctcactctgttgcccaggct

SEQ ID NO: 74123 - DNA, 324 bp, Homo sapiens
aagggacagggcatcgtctgtggggatagtgggggtagtgggggtagtggtcagccagacttggtgactctacttgctcaccagacgatcctacacctgccacctccgatggatccactgcctctgtgcctgcctgtactgccgatgcttcagtggataactcagcatcccagccaaggcccaatgccactgaagatggacctgccccctggggacccaggagtcctaccactcagctgtccccaggagtgcccagacccccacagagagagcgtcccccacagagagagcgtccccacagaagagcgtcaccccacagagaga

SEQ ID NO: 74124 - DNA, 302 bp, Homo sapiens
ttggtgatatgagacttccattcttccaggtggaagatgagctcagctccccagtggtggtgttcagatttttccaggaattaccaggctcaggtgggtgaattttaaaagagggttattttcatatctgtgttaaaggctttgaatttgataccatttcaatttaaatatttcaaaatatttttattgctgacaatcttcagtcagcatttcagaaaaatgtaataattttcatgaaaacttcagtccgaaatgccttagcaatttgctgatagtttgcggtgattaaaccaggggttccc

SEQ ID NO: 74125 - DNA, 3986 bp, Homo sapiens
  misc_feature (2747)..(2747): n is a, c, g, or t
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74126 - DNA, 3996 bp, Homo sapiens
  misc_feature (2757)..(2757): n is a, c, g, or t
ctggtacgcctccggattacgggatggggcccgcccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74127 - DNA, 5044 bp, Homo sapiens
  misc_feature (3805)..(3805): n is a, c, g, or t
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggaggggtaagctggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74128 - DNA, 2762 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcaggtatgatctcgtgaaaccttgagagaaactgaatgaggaatgaaactattgttcctgtttcacacagaagaaaactgaggttggcactcatgatgagcccctgttctcattctgcaaatggtgaagctctctatcgtcctgaccccacagttcctgtcccatgaccagggcccgctcaccaaggagctgcagcagcacgtaaagtcagtgacatgcccatgcgagtacctgaggaaggttatcaatactctggctgaccatcgtcatcgtgagactgactttggtggaagtccttggataattatcattattgtgtttctgggacgttacaaatttaccattctcttctgcacaatttacctttgtgtgcctttcctgaagactatcttctggtctcgaaatggacatgatagatccagggatgtacagcagagagctaggaggtccaaccgccgtagacaggaaggaattaaaattggcctggaagacatctgtactttatggaaacaggcggaaacaaaagttcaagctaaaatccgtaagatgaaggtcacaaagaaagtcaaccatcattacaaaatcaatggaaagaggaagaccgccaaagaacagaaaatgtttcaacgtgcgcaagagttgcggtggcgggcagaggactaccacaaatgcaaaatcaccccctctgcaagaaagcctctttgcaactgggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtcttcttattccccttccaccctctcctcttccaccctccgtggatgataatctcaagactcctcccttagctactcaggaggccgaggcagaaaaatcactgaaacccaagaggcagaggttgagtaagctgagaacaggtcattgcactcaagcctgggcaataagaagaaatctgtgagtggaacaaaagaaaaaaatcaaaaaacaaaacaaaacccacactccaaaaacaaactaacaaagaataaataaataatataaaaataaaataaatactgcagtc

SEQ ID NO: 74129 - DNA, 3940 bp, Homo sapiens
  misc_feature (2701)..(2701): n is a, c, g, or t
agaggccagggacgcctctaaacatcctacgttgcacaggacagccccccacgctggagaattctctggcccaaaatgtcagcagtgttggggctgagaaatcctggtcaagatcatgtttataacaccagcagttgagtacaaaatgatgcaaagtggtgttatcaatttcctaagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74130 - DNA, 4112 bp, Homo sapiens
  misc_feature (2873)..(2873): n is a, c, g, or t
ctggtacgcctccggattacgggatggggcccgcccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagttgcttaagaaaaaaaaaaaacttgaagcaacgccagttgaatgagggaagtagcgggagagtggcgggggatgtgtgctgttcccatcagcccatcaactcttttcattctgcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74131 - DNA, 4975 bp, Homo sapiens
  misc_feature (3736)..(3736): n is a, c, g, or t
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggaggggtaagctggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74132 - DNA, 2009 bp, Homo sapiens
  misc_feature (2004)..(2004): n is a, c, g, or t
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtaaagtcttggcctgccgcttgatgttggagacttttctgtataaagaacatgagtgggtcattttctgaaccaccttagaaatccaagatgaacgtgtagtcacaatatgcttaacgaaaatgcaactcggttttctgggcattaacaacagcacagtgcaagcaggcaatttggccagcgagacgctcagggaggggagttgctgaatgttctgtctgttgggtnccggc

SEQ ID NO: 74133 - DNA, 2710 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcaggtatgatctcgtgaaaccttgagagaaactgaatgaggaatgaaactattgttcctgtttcacacagaagaaaactgaggttggcactcatgatgagcccctgttctcattctgcaaatggtgaagctctctatcgtcctgaccccacagttcctgtcccatgaccagggcccgctcaccaaggagctgcagcagcacgtaaagtcagtgacatgcccatgcgagtacctgaggaaggttatcaatactctggctgaccatcgtcatcgtgagactgactttggtggaagtccttggataattatcattattgtgtttctgggacgttacaaatttaccattctcttctgcacaatttacctttgtgtgcctttcctgaagactatcttctggtctcgaaatggacatgatagatccagggatgtacagcagagagctaggaggtccaaccgccgtagacaggaaggaattaaaattggcctggaagacatctgtactttatggaaacaggcggaaacaaaagttcaagctaaaatccgtaagatgaaggtcacaaagaaagtcaaccatcattacaaaatcaatggaaagaggaagaccgccaaagaacagaaaatgtttcaacgtgcgcaagagttgcggtggcgggcagaggactaccacaaatgcaaaatcaccccctctgcaagaaagcctctttgcaactggctctgtgctcaagccctgcagagggagatggcagagaggaaggctgcctacaagcatcacagtcccatccctgttggtaaccgtgttgtgcaaaaacaccttcatccccacccagtggggcccctgatctaatattcaaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacagttttaaaacttgctttgtttagaattcccacctcatttttccatggac

SEQ ID NO: 74134 - DNA, 3346 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgccgttaccacctcacgaagctgggtcacctctggcaagtccttcctggcattgctccctcactttccttgctgctgtataaggctgtgagacaacaggcaaaaggtgggctgcagggcagctgcagtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcggttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcaggaatcagctctccaggaggctctttggtctggggccgaggggatgagggtgggtcctgaagacgtctgagtcccttgttacaggagggtgttcattgtgtcctcctcacagctgggagaacagctgaagcagctggtgcctgcaagcggcctcacagtcatggatctggaagctgagggcacgtgtttgcggttcagccctttgatgaccgcagcaggtaaaccaggcttggtggacatcccttgcttttgttctggggctgctgggtagattagcttgcccttatgatactccattctcctagagttattagcagctctttttggaggggcattttcttttcttttgggctaaatttaggtagattagcattcccatgtaacttaccagaatcagaatgagaattcagaagtcacctgaattggccgggcatggtggctcacacctgtaatcccagcaccttgggaggccaaggcaggcagatcatctgaggtcaggagttcgagaccagcctggccaacatagtgaaatcccgcccctactaaaaatacaaaaaattagccaggcaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggtggcatgcgcctggggtcccaagtactcgggaggtagaggagagaaaaatcacttgagcccagagagg

SEQ ID NO: 74135 - DNA, 2342 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcaggtatgatctcgtgaaaccttgagagaaactgaatgaggaatgaaactattgttcctgtttcacacagaagaaaactgaggttggcactcatgatgagcccctgttctcattctgcaaatggtgaagctctctatcgtcctgaccccacagttcctgtcccatgaccagggcccgctcaccaaggagctgcagcagcacgtaaagtcagtgacatgcccatgcgagtacctgaggaaggttatcaatactctggctgaccatcgtcatcgtgagactgactttggtggaagtccttggataattatcattattgtgtttctgggacgttacaaatttaccattctcttctgcacaatttacctttgtgtgcctttcctgaagactatcttctggtctcgaaatggacatgatagatccagggatgtacagcagagagctaggaggtccaaccgccgtagacaggaaggaattaaaattggcctggaagacatctgtactttatggaaacaggcggaaacaaaagttcaagctaaaatccgtaagatgaaggtcacaaagaaagtcaaccatcattacaaaatcaatggaaagaggaagaccgccaaagaacagaaaatgtttcaacgtgcgcaagagttgcggtggcgggcagaggactaccacaaatgcaaaatcaccccctctgcaagaaagcctctttgcaactgggtaagtttgtttgttttccttgcttttgga

SEQ ID NO: 74136 - DNA, 3915 bp, Homo sapiens
  misc_feature (2676)..(2676): n is a, c, g, or t
ctggtacgcctccggattacgggatggggcccgcccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74137 - DNA, 2394 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacaatttctccttcctctggtaacctctgttttcttagatttggagcagggtggtcacactgaccttgcagagttccgagaatcagagacagaacataaaaggcctggaaaacattctccaaaaagaagctgcaacatgtgtggacaatgggcttttcatgcctctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatattatgacactgatactgctattttgaaacctggaggatggaaaggtgcaaaaatctatcaccagcaacagaaggtgcagaccgtgttggtggcggtaattttgtccatcaaatgaatatgtgtgaaaacattcccttcttcggccctacaggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtctcctacatccccttccaccctcagtggatgataatatcaaggagtgtcctcttgctcctcttccaccctcagtggatgataatctgaaggagtgtctcctggtccctcttccaccctctcctcttccaccctcagtggatgataatctgaaggactgtctcttattccccttccaccctctcctcttccaccctccgtggatgataatctcaagactcctcccttagctactcaggaggccgaggcagaaaaaccacccaaacccaagaggtggagggtggatgaggtggaacaatcaccgaaacccaagaggcggagggcggatgaggtggaacaatcgcccaagcccaagaggcagagggaggccgaggcacaacaatcactgaaacccaagaggcagaggttgagtaagctgagaacaggtcattgcactcaagcctgggcaataagaagaaatctgtgagtggaacaaaagaaaaaaatcaaaaaacaaaacaaaacccacactccaaaaacaaactaacaaagaataaataaataatataaaaataaaataaatactgcagtc

SEQ ID NO: 74138 - DNA, 1980 bp, Homo sapiens
  misc_feature (1641)..(1641): n is a, c, g, or t
  misc_feature (1670)..(1670): n is a, c, g, or t
  misc_feature (1685)..(1686): n is a, c, g, or t
  misc_feature (1708)..(1708): n is a, c, g, or t
  misc_feature (1719)..(1719): n is a, c, g, or t
  misc_feature (1722)..(1722): n is a, c, g, or t
  misc_feature (1737)..(1737): n is a, c, g, or t
  misc_feature (1739)..(1739): n is a, c, g, or t
  misc_feature (1747)..(1747): n is a, c, g, or t
  misc_feature (1759)..(1759): n is a, c, g, or t
  misc_feature (1769)..(1769): n is a, c, g, or t
  misc_feature (1773)..(1773): n is a, c, g, or t
  misc_feature (1776)..(1776): n is a, c, g, or t
  misc_feature (1798)..(1798): n is a, c, g, or t
  misc_feature (1818)..(1818): n is a, c, g, or t
  misc_feature (1829)..(1829): n is a, c, g, or t
  misc_feature (1847)..(1847): n is a, c, g, or t
  misc_feature (1910)..(1910): n is a, c, g, or t
  misc_feature (1912)..(1912): n is a, c, g, or t
  misc_feature (1917)..(1917): n is a, c, g, or t
  misc_feature (1946)..(1946): n is a, c, g, or t
  misc_feature (1950)..(1950): n is a, c, g, or t
  misc_feature (1955)..(1955): n is a, c, g, or t
  misc_feature (1975)..(1975): n is a, c, g, or t
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcaggataccacatggagcattttgaggagtgctggccagnatcgacattttttcaagaagcctggttcnttttactggagattnnttttttttggagaacagagacntgggcaccagnggnggatcagaggacttntntcctgagnttgccagaaaantgttgaacanaaanttntacacaaccgaacaggcccaantttcaaatggactgagaatnacccacacaanttccaccgaggccaaggntgacctgcagccagcgacagggaaagactgccacttactggcggcctccggaactggaaggantntactnacaattttttttttcgcaagcttttaacntttntaccntcaataaaaaccccattaanattta

SEQ ID NO: 74139 - DNA, 2114 bp, Homo sapiens
  misc_feature (1775)..(1775): n is a, c, g, or t
  misc_feature (1804)..(1804): n is a, c, g, or t
  misc_feature (1819)..(1820): n is a, c, g, or t
  misc_feature (1842)..(1842): n is a, c, g, or t
  misc_feature (1853)..(1853): n is a, c, g, or t
  misc_feature (1856)..(1856): n is a, c, g, or t
  misc_feature (1871)..(1871): n is a, c, g, or t
  misc_feature (1873)..(1873): n is a, c, g, or t
  misc_feature (1881)..(1881): n is a, c, g, or t
  misc_feature (1893)..(1893): n is a, c, g, or t
  misc_feature (1903)..(1903): n is a, c, g, or t
  misc_feature (1907)..(1907): n is a, c, g, or t
  misc_feature (1910)..(1910): n is a, c, g, or t
  misc_feature (1932)..(1932): n is a, c, g, or t
  misc_feature (1952)..(1952): n is a, c, g, or t
  misc_feature (1963)..(1963): n is a, c, g, or t
  misc_feature (1981)..(1981): n is a, c, g, or t
  misc_feature (2044)..(2044): n is a, c, g, or t
  misc_feature (2046)..(2046): n is a, c, g, or t
  misc_feature (2051)..(2051): n is a, c, g, or t
  misc_feature (2080)..(2080): n is a, c, g, or t
  misc_feature (2084)..(2084): n is a, c, g, or t
  misc_feature (2089)..(2089): n is a, c, g, or t
  misc_feature (2109)..(2109): n is a, c, g, or t
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagctcccgaggggctgctctcatggacaccatcaggtgctgggaagcaggaaccaccaggacctggacagagtccccagtgaccggcctggcagacagaggagccctcagctacagcatcacaaacaacgggtggggataccacatggagcattttgaggagtgctggccagnatcgacattttttcaagaagcctggttcnttttactggagattnnttttttttggagaacagagacntgggcaccagnggnggatcagaggacttntntcctgagnttgccagaaaantgttgaacanaaanttntacacaaccgaacaggcccaantttcaaatggactgagaatnacccacacaanttccaccgaggccaaggntgacctgcagccagcgacagggaaagactgccacttactggcggcctccggaactggaaggantntactnacaattttttttttcgcaagcttttaacntttntaccntcaataaaaaccccattaanattta

SEQ ID NO: 74140 - DNA, 3806 bp, Homo sapiens
  misc_feature (2567)..(2567): n is a, c, g, or t
ctggtacgcctccggattacgggatggggcccgcccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74141 - DNA, 4030 bp, Homo sapiens
  misc_feature (2791)..(2791): n is a, c, g, or t
gaaaaatacgtaaatttatacctagaaaatatctgaaaggttatgtattaaactgttaacggggtggattggtggcttatagggtagggggctaggcattttcacttctaatacctgtgtttttttttgaggatttgttttacttgggtgtcacattcataatttttaatcctttaaggagaaaaatgtgcttattaaatttttggtctctgaatgctaccaagtcttagtcatacagaacaatatgctgcaactgtttacaattcctaaaactgtaaactcctcaaggacttggaggctaaacatgaagaatataaaattaagttgacaatcactgtctcctgcataacactgacttcacttctcttgagaaatgtgcatctgctaatccatatttattactttttaggggtgggtgaacccataaataagatactgttctttgaatgcctttagctggtgttatttaccagtaatgcttggagaaagaatccaaaattacccccactaaaatgctcacgacccagttgtttctgtgtttgtcaaagtgtttctggtatattctagaatataccaaagataattacttgaatcatttagaaaattttacattatatcctcttataaggcacttggaaattcaccctttttttttttcggcttggctttctaaatgtactttaacatcaatttataatattaagagttcctaaggagagagatttcttagaagaataatcgtggcttgtcttagagccacagcctttcacaatctgaagtgaatggtgcagagagctttcttgtcaagtcgtatgtttcttcctgcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74142 - DNA, 3175 bp, Homo sapiens
  misc_feature (1936)..(1936): n is a, c, g, or t
atactaggcacctcattttttaatgatttgttttggttccaggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74143 - DNA, 2551 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggaggggtaagctggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtatagtatataatttcatctgttttcaaaatataactttttttgaacttcagcaacttagaatgattttagaactttagaatgattttctccacatttcagtggaattgtggcagctccagtaaaaaacaaaacaaaaaacaaaaac

SEQ ID NO: 74144 - DNA, 3045 bp, Homo sapiens
  misc_feature (1806)..(1806): n is a, c, g, or t
tccctttaaagagtagcggaggctgggtggcgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74145 - DNA, 2890 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggaggggtaagctggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactggtgagtagaagcctgacatttaaatgaaagactccttggccacagcagagacagaaaaacatctcatttctgtaccttccatccagagtggtgttgtctggattgactgtctcgtgagccagagactaatcgccctgcatgtaaatatttcttgttcaaagttctgggagaaagtgctgggttgtctgtcccagcatttgtgtgcagatgaaatcagatgaaaaggaacaccactgtcagcatgggatcagaaaagaagtcacagatgacttccaaggagtggagaagggtgcaaaaggtggaggggtggggagcgagtgttccccttgattgactgactacggtgagggaataggaaggttacaaggtggttatggagggcatggatattttaaaaaccagctggcttgggtttccaaattgcagggctcttggggacaattctaattctctctccattttaggtgtgttctaattgtgaaaaatatataattatgctatatttcagtgttttagagcattcagccttctataacaa

SEQ ID NO: 74146 - DNA, 2367 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggaggggtaagctggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttggtaagtttcccctcactgcggagggagtgggtgtggctaatacacattattggctttgggggcaaaatccagaaaaatacaggaaaaagtgaaaaatacccataatttcacttctatttcatttttttaaagagaaacttg

SEQ ID NO: 74147 - DNA, 3282 bp, Homo sapiens
  misc_feature (2043)..(2043): n is a, c, g, or t
gccgtgtacccaaggtcccttagcctctgagtagtggggaccacagcacataccaccacagccaggtaatttgtgtagtatttgtaaagacaggtctcactatgtgcctaggctggttttgcactcctggccgcaagcaatcctcctgtctcagcctcccatagcacagaagttacaggaatatgaaccacatctggccagcaccaagtattttgacaaagcacctattagggtaattccaagtaatctctggcaaacatggtttcagttaggcaagactacaagaaaccgcccacatctatttggtaaaaatctgtgctcccctttcctacttgagtagacacgctcacaaacagacacaaaggcagacccctccctctagtttttctaacataccagagccccctgcaaacacccgaggccctcaatgctgattttcactggaatctcatcacagttgggcttaagggacccttgggccaaggtcccttaagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74148 - DNA, 1065 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74149 - DNA, 2484 bp, Homo sapiens
tgcctatcctgcctgaggggactccatcattttctatcagagcccccagcttcacttgtgacactaacaaccacatggagtgattttctttctttatggtctgtttcctcaactaaaatgtaagctccaagatgacagaaaccttacctgccttctgtcccaagtgtcaggctctgtgcctggcacgggtgggcacccactgtgaggcctagttagatgatcgtggcactcacagacctcgcacggtgcttggtaaactagttagtaacttaaaacaattgctgtttccccttgaaatcccttgaaagcaaaccttttcaaaaatgaaattaataattctgtcttatgtgaatgtattcaagtgttacatagatcacgaggagaaagaaatgtagcccttctgtcagataatacatgagaattcagtaatacgagtcagtgccctggggctaatattgggatgggaatgatgtggggtttggagggtgttttttttttggtcagccgtgtttctgggagtgactccctttctgtgttttggtgtcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgccgttaccacctcacgaagctgggtcacctctggcaagtccttcctggcattgctccctcactttccttgctgctgtataaggctgtgagacaacaggcaaaaggtgggctgcagggcagctgcagtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcggttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcaggaatcagctctccaggaggctctttggtctggggccgaggggatgagggtgggtcctgaagacgtctgagtcccttgttacaggagggtgttcattgtgtcctcctcacagctgggagaacagctgaagcagctggtgcctgcaagcggcctcacagtcatggatctggaagctgagggcacgtgtttgcggttcagccctttgatgaccgcagcaggtaaaccaggcttggtggacatcccttgcttttgttctggggctgctgggtagattagcttgcccttatgatactccattctcctagagttattagcagctctttttggaggggcattttcttttcttttgggctaaatttaggtagattagcattcccatgtaacttaccagaatcagaatgagaattcagaagtcacctgaattggccgggcatggtggctcacacctgtaatcccagcaccttgggaggccaaggcaggcagatcatctgaggtcaggagttcgagaccagcctggccaacatagtgaaatcccgcccctactaaaaatacaaaaaattagccaggcaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggtggcatgcgcctggggtcccaagtactcgggaggtagaggagagaaaaatcacttgagcccagagagg

SEQ ID NO: 74150 - DNA, 1046 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttgttgagtgaaaagaaagatggtcttatatgcttttgtcatatttgtaaaaattactgaatttagaaataaggaatatgtgatagattacccaagggcatccacagtcaacattttctcttttttcccagactttaatcgaagggggtgtgtttgtgtttatatggttgt

SEQ ID NO: 74151 - DNA, 1062 bp, Homo sapiens
aagtcagcaggcagtaagcaagaggaggaatcaatatagcaacagtttggatcagactgtacagtttttttttgtttttctgagatggagtctcgctgtgtcacccaggctggagtgcaatgacgtgatcctggctcactgcaacctccgcctcccaggttcaagtgattcccctgcctcagcctcccgagtagctgggattacaggtgcctgccaccacgcccggctaattttttgtatttttagtagagacggggtttcaccgtattagccaggatggtctcaatctcctgacctcgtgatccatctgcctcgccctcccagagtgctgggactacaggcgtcagccaccgcgaccagctcagactgtactcttatagccctctgaaatacgttttctaggtagagatagattgtgtaagggtacagttatgaggataacagaaacgtggcagattatttaaaatcatcctgaaagtggtgctttatctgatgaaagtgattgtaatccataggaaaatgtttcaacgtgcgcaagagttgcggtggcgggcagaggactaccacaaatgcaaaatcaccccctctgcaagaaagcctctttgcaactgggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtcttcttattccccttccaccctctcctcttccaccctccgtggatgataatctcaagactcctcccttagctactcaggaggccgaggcagaaaaatcactgaaacccaagaggcagaggttgagtaagctgagaacaggtcattgcactcaagcctgggcaataagaagaaatctgtgagtggaacaaaagaaaaaaatcaaaaaacaaaacaaaacccacactccaaaaacaaactaacaaagaataaataaataatataaaaataaaataaatactgcagtc

SEQ ID NO: 74152 - DNA, 1112 bp, Homo sapiens
ggcaagcagttcaagaccacacctgagcaacatagcgagacctcatctctacaaaaactaattttaaaaaatagagctgtgtgaccccgggcacaatttctccttcctctggtaacctctgttttcttagatttggagcagggtggtcacactgaccttgcagagttccgagaatcagagacagaacataaaaggcctggaaaacattctccaaaaagaagctgcaacatgtgtggacaatgggcttttcatgcctctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatattatgacactgatactgctattttgaaacctggaggatggaaaggtgcaaaaatctatcaccagcaacagaaggtgcagaccgtgttggtggcggtaattttgtccatcaaatgaatatgtgtgaaaacattcccttcttcggccctacaggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtcttcttattccccttccaccctctcctcttccaccctccgtggatgataatctcaagactcctcccttagctactcaggaggccgaggcagaaaaatcactgaaacccaagaggcagaggttgagtaagctgagaacaggtcattgcactcaagcctgggcaataagaagaaatctgtgagtggaacaaaagaaaaaaatcaaaaaacaaaacaaaacccacactccaaaaacaaactaacaaagaataaataaataatataaaaataaaataaatactgcagtc

SEQ ID NO: 74153 - DNA, 660 bp, Homo sapiens
  misc_feature (655)..(655): n is a, c, g, or t
tatgtgtggtgatctagaggatcccacaaggctgactcttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtaaagtcttggcctgccgcttgatgttggagacttttctgtataaagaacatgagtgggtcattttctgaaccaccttagaaatccaagatgaacgtgtagtcacaatatgcttaacgaaaatgcaactcggttttctgggcattaacaacagcacagtgcaagcaggcaatttggccagcgagacgctcagggaggggagttgctgaatgttctgtctgttgggtnccggc

SEQ ID NO: 74154 - DNA, 776 bp, Homo sapiens
aggatactttcagataccaccttatggctatgcagaattttcaggtaaagacatgatgagtttccagtgaagacttttatgagtcgggtatagactgaaagatcttttttctggagctgtactacttgggttcagatttccttctccttgaaaggggtgtttaacctctcaatgtctgtttcatcatctgttagatggggatagtattaatacctatttcatagaagcgttgtgaggattaaatgagctaatggactaacgcatgtgaagggtggagaatagaagcacatatgtgtttgatagggtcagcagttatttatttgtggggtatctaattggcacatgtcagtagaagatagagcaatgatctagattcaaatacagttgtcccttatccttgggtgtccttgggggattggttcttgacctcccatcctcaccctatggataaaaaaattcatggatgctcaaatcccttatataaaatagcacagtattttcatgtaactgaggcacatcttcccatatactttaatctcgttgacttacatataatacctaatacgatgtaaatgctgtgtaaatagttgttacactgtattgtttagggaataatgacaagcaaaaaagtctgtagatattcagtacagaggcacccatctttttaaatttctgaagattttttactcatgcttggtttaatccacagatgcagaacccacaggttcagagggccagctgtgctttgaaaatattagcttgcgttttattagaaa

SEQ ID NO: 74155 - DNA, 432 bp, Homo sapiens
gtaagtttatatcagaattcattttataatttgagctttgttttttaaaaagcataaactatataccacgttctttctcttatagttgcttaagaaaaaaaaaaaacttgaagcaacgccagttgaatgagggaagtagcgggagagtggcgggggatgtgtgctgttcccatcagcccatcaactcttttcattctgcagtgggcaagatatggtgagcatcctccagttagttcagaatctcatgcatggagatgaagatgaggagccccagagccccaggtaatgaacctggcagcttctcttttcaagtgcatgtgttcttgatttcagtagtgattgcgctctgacaagttgctcaaataagaagctatatttcattgagttacatatgatattaaagcaatcctttttattttcagaaagacattt

SEQ ID NO: 74156 - DNA, 4424 bp, Homo sapiens
  misc_feature (3185)..(3185): n is a, c, g, or t
aaaccacaattttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatgtgttttatcctaggaacggcagcagtaggacacacagacaagattgggagattgaaagaactctgtgagcagtatggcatatggcttcatgtggaggggtaagctggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74157 - DNA, 1493 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtatagtatataatttcatctgttttcaaaatataactttttttgaacttcagcaacttagaatgattttagaactttagaatgattttctccacatttcagtggaattgtggcagctccagtaaaaaacaaaacaaaaaacaaaaac

SEQ ID NO: 74158 - DNA, 3981 bp, Homo sapiens
  misc_feature (74)..(74): n is a, c, g, or t
  misc_feature (2742)..(2742): n is a, c, g, or t
ttattttccaagttatcattctttacttagggacccaaaaagaaaccctccctgtatgatgtggtggatatggnctactctggctgcccacgtccgttccccctgcttctcttaatggccctacaatagccttccagggcgccatctccatttcttccagcagaacatgagctttgtggggaggagacaccactctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74159 - DNA, 3168 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggaggggtaagctggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctcatgttctgctggaagaaatggagatggcgccctggaaggctattgtagggccattaagagaagcagggggaacggacgtgggcagccagagtagcccatatccaccacatcatacagggaggtttctttttgatccctaagtaaagaatgataactggaaaataagatccatgaaagagaataatactcccattatattaaatgagcggggatagttcctgagacacatttttattaaagtgcattttcaggattttccttcatatgtataaagcacaccttctgttgctgttaatgaaagctaataacattaaaaatatacttaagtgtcaacttgcaacagcacagcctttatttttttaagtacatggtgagtaagcaacattaaataattagttcttggactggtgttttttcttccagtgtgaatctggcaacattggctctgggttatgtctcctcatcagtgctggtatgttgttgatttactgaatattggtgtttttaagaatgaatttaaaatcactcaatccctcctggctcttcacagtttttatgaatggaggagggtgttaggtttgtgtattctgataatctaacaaagagttgttcttgttttggtaggctgcagccaaatgtgatagcatgacaatttctccttcctctggtaacctctgttttcttagatttggagcagggtggtcacactgaccttgcagagttccgagaatcagagacagaacataaaaggcctggaaaacattctccaaaaagaagctgcaacatgtgtggacaatgggcttttcatgcctctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatattatgacactgatactgctattttgaaacctggaggatggaaaggtgcaaaaatctatcaccagcaacagaaggtgcagaccgtgttggtggcggtaattttgtccatcaaatgaatatgtgtgaaaacattcccttcttcggccctacaggtcagaatggcggcagcggagcatcgtcattcttcaggattgccctgctggccctacctcacagctgaaactttaaaaaacaggatgggccgccagccacctcctccaactcaacaacattctataactgataactccctgagcctcaagacacctcccgaatgtcttcttattccccttccaccctctcctcttccaccctccgtggatgataatctcaagactcctcccttagctactcaggaggccgaggcagaaaaatcactgaaacccaagaggcagaggttgagtaagctgagaacaggtcattgcactcaagcctgggcaataagaagaaatctgtgagtggaacaaaagaaaaaaatcaaaaaacaaaacaaaacccacactccaaaaacaaactaacaaagaataaataaataatataaaaataaaataaatactgcagtc

SEQ ID NO: 74160 - DNA, 4031 bp, Homo sapiens
  misc_feature (2792)..(2792): n is a, c, g, or t
taggaccctgtctcaaaaaaaaaaaaaaaagtttgatgctcattatgtttacaaaagcactgcattttttgaaaagtgtctcactgtgctattagctcatttcttgagatgtggttcttaggaaagagaagccttagtaacttagtttagagatggcttgggcactcgggagattttttcaatttcctgtggctatggagtgcaggagaatgatgccattaactaccagacccttgaggtcagcacagctctggcatcttcctgcaggcagaaccgtatactcctgaggatttgaatgctgtcctactgctgactcaaaggctaatcaatgcatgtgttaaactgcatggacatttagcagacatggtgatctgtatatagccatgccttatagtccacagtggagcatacatttcctgagagcgtaaatcagcattcgcctcctcctcctcctcttccttctcttctccctctctcctttctcgtcttcagtagttattgagcattcacctcagtgtcaggcaccatgagtactttcatgcatcatctcatttgatccctgcaacttcactagaatgtcagttccactgatgacagtgtattcagaattaattttctttaaggaaaacaaaaaggaatttcttgaggggctttctactgtccagtactcagtgaatatctgttgaattaatatactccaatcccatgagttagatatgattagtgatgagggacctgggattgagacattagtctaatgacactacattctagaccctgttgctaagcacttcttgtattgcatatcaactcatttactcctcacagcaatgtgagatacatactgtcctccctgttttataattgagggaactgaagcatagacaggttacatagctggtgactggcagatgaagtgacttatccgtggtcctgcaggtgatgagtggcagtactgtgctcttatcaccagctcttgagcgtgctgcatcctctcatttgtcgttggtctcccctagtgttcggtactgtgccttgcacgtgtttatactcagtagcttttgaatgaaagacagacttacattgcaaatacaacagatttccgtgtcttattagaaactgcttttcttgaattactacatgtaacttttaaatgaaagattggtgaatatttccagatgttgaaatacaaaaacaggtggctgaacttagaaaccaccaagtggcaggtgactttgcctgacatccgtgttcacagacctccacagcccctggtgaaaaccacttcttcatatcccatgtccgtctaattacatgtgttattttttgtcatttgcagagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74161 - DNA, 921 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttcgcaagtaactgtgcgttcttttaccctcaagaaacagctgtga

SEQ ID NO: 74162 - DNA, 1283 bp, Homo sapiens
agcggagcgctacggggccccgccccgccgcctctcaaccatcaggttcggcagccggcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgccctttccctgcttgtgccgtgtaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74163 - DNA, 2566 bp, Homo sapiens
  misc_feature (1327)..(1327): n is a, c, g, or t
ctttgagctcggtacccccttccctctctcacgctgatccagccgggcaccctgcttaagtcagtagaagctcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgnctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaaa

SEQ ID NO: 74164 - DNA, 215 bp, Homo sapiens
aactcgggtatgctgtatcctttacccagagtcaccaattccttctgttttgaccatctgctttatctttctctatttttatagacatgcattttcctgagccattgaaagatggagcataccccttttacttccaaatacttcagtgtataagaacaagatcattttcttatataacccataggataattatcaaaaacaggaaatttaacatt

SEQ ID NO: 74165 - DNA, 412 bp, Homo sapiens
tttggagacagaatttcctctgttactgaagctagagtgcagtggtgtgatcaccgttcatcgcagcctcaccctctagggctcaatcaatcctcccacctcagcctcccacgaagctgggactacaggcatgtgccccgacacccagctaattttttttattttttggagagatggggtttcactatgctgctcaggctggtctcaaactcctgggctcaagcgatccacccatgtcagcctcccaaaatcctgggactacaggcgtgagccaccttttaaccatttttaagtgcacaattcagaggcattaagtacattcacaacgttgtgcaaccatcactacccattcctagagcttgttcagcatcccttcaattcatcaccaattaaattgttcattgaattctaa

SEQ ID NO: 74166 - DNA, 518 bp, Homo sapiens
tccgtctttggtggaacatggagacctccctactcttgaatctcaatacgtggagggggaagctgctggaggaggataaagcgctcagcagagaggagaaacatcaaacctctgtacttaccagtggggaaggcactatagaaatgagctgattttctctacagagacccagaaagggtccaggatcagaggcaccaggtatcacaggaagtggggcaggacctgagaataggggtagggggtagtttgaaagtctgtgtaaggagcagtagacttccaagtcccactccatcctatgcagccaggtgactgtcctccttactcccacgagagaccagaggtcctggtctcagagatgccaagtgtgaagagaaggggtgaggtgtcctaataaaggctcccagcctccttccccacccacctccagggtaccagaatcaggcttatgcctgcatcctgcactaaccccatgcaaagattgaagtgtgttttcactggaggaattaaacaagcccaaa

SEQ ID NO: 74167 - DNA, 613 bp, Homo sapiens
gtatttgctttcccttcatctttgtcatgattgtaagtttcctgaggcctccccagccatgcttctggtatagcctgcttaactgtgagccaatgaaacttcttttctttgtgaattatttagtttcaggtgtttctttatagtgatttgagaaaagactaatacagttactgacagaatagtatccccattcactatgtgagtaactcttctttaaatgttgtggtttcatctagagatttatcttctgacccaccaaggaccaaaccatgaatgtagggaatggggtttcatttaaaggcggcactgtgaagtcaggtatttctgtcagtctttctgtcagcactttaggcaaagcaaattggaagtgaactgaacagatgggacctgttaagagagacccttaggaaggtctccaggtggggccgcaatccttaacattgccatatagcaaattcttcttctcttggtaataaatagactaacagaccatgattatttttcttaatcaaagaaccaaactcctaagcctttttttaatagacagcctgctttatatctacactgatgaagaaaataagaaatatctaataaagcttaagatgtatctgct

SEQ ID NO: 74168 - DNA, 252 bp, Homo sapiens
tatcacaaaatatttggtaccgtaagttttgaataatagtgacaaaggtaacaattggattcttgattattcataaaaagcacccttgggtatggttttctattagaagagatatatatgtatgtgtgatggtttttgatgaatgagcgtattaaacacatctcagaaaaagttctaaatgatttttcagaaggatttcttattatatacagccaaagaattatttaatgaatagtatttatgtatgttttt

SEQ ID NO: 74169 - DNA, 383 bp, Homo sapiens
tttctcatctcaacggcactccatcgttttggaacaaaccagcagtcttcctacctcatggcttggcactaggttttctctgcatggaaagcctttcccatggatatctttatggattactcccccaccgtttcaggtttttgtcaaatgtcactttcttcgtgaggccttccctagcagacttcattaaaactgcaacactctcatcctggtctctgctttatttttctccaaagaattattgccatctgaaaaattatatagtctatttatttatttgtattcagaatacaagctccacaagaccaggaatttgatctttttatccccaaccactgaaacatttgcctgacacatagtgggtactcaatttgtatttgtcg

SEQ ID NO: 74170 - DNA, 553 bp, Homo sapiens
atggaaacattctaaaacagaattgtggtgacggttgcacaactctatgtatttgctaaaataactaaattttccagttacaatgggtgagttttaggatatgtaaattatgcctcaactctaaaaaagaaaaacctatgacttgaaaagttaggaaaaaataaaatctagggatagggctgaaggttacactcagaatgaatacgtggctttaaattcttttattattaaaaagcaaactaaaaataagtcaactctctattcaacttaataaatgaagaaaaggttaaaataaaagacataggataattaaagataaaagtacagatgaataatactgaacacaaacagaacagtcaaaagaataaatgaacttataaggagacataaccgccactgataaggaagagattaaaaggtgcattaaacaatgaccatgtactagttaacagacccccctttctaaatggacgcactgtgctaagaagctacagacgtttcatagagaaaagcaacaggcccactgagttccaagtcaaactttcaaccctat

SEQ ID NO: 74171 - DNA, 400 bp, Homo sapiens
ctgttcttctgatggatttgggcagggtgtatgttagcatcagacgcaaggagggctagccctggtggcctgcggagtaaatgctggtgggaccggggtgccacctgcctgcagactcggcctgttgctgctggactcctggggggcaccattttggggctttctgcaaccacctctgtgtagcagtttagagcagaagaagaagtagtaggaaatagtctttgtccaccaaggacgtcactgaggaaggggtaccgggggtacccttgaaatggaggagggaggaggtggacggtgaccgaaggcctgatgtcctgaggccaggggccaagtccctgttacctgtatgtcccatgcacttttttaaactgatgctgaagttggccaatgttttacttaa

SEQ ID NO: 74172 - DNA, 409 bp, Homo sapiens
ctgcaataaacatgggagtgcaggtatctctttagtattattgatttcctttctttggggtatgtacctaggagtgggattgccgaattataagatagctctagttttagctttttgaggaacctccaaactgttcttcacagtggttatactaatttacattcccatctacagtgtacaagggttcccttttctccacattctcgccagctagctccttggcagtgtgttaatgtgttaacctgcctactttagagttaaaaaaaatgctgagtttcagacctgagttgtagataaaaatagaatccaactcagatcttataagagactttaatgcagggactacagaggtgccgtggattaagggaacccataaggcatgtttttactagcagcagagaagcccaaa

SEQ ID NO: 74173 - DNA, 412 bp, Homo sapiens
ttcttttatgttttagttgttgttctttttagaaacatgattaaaaaggaaaaaatattaaatcaataagtgttaaatcaaaatggaatatctgattcaaaccattttacaagaatgaaagtaaaatgtgcatgatcaagcttagtatcttggtttttgaactctggtcaactggatatgtttgtcattttgtaacttaccaaaaacaaaccatcatatcataccaactaaaatgatatatggatgaagcaacatcaagtaaaattttagacgatggctataggacccaaatctaaagctgtctaaatgttaattcaatgaaacaagtattatttttgcatgaatacaatgttacaaataaatcacaagaaatagggaagatctgtttgttgcttggaaagaaaaaaattac

SEQ ID NO: 74174 - DNA, 513 bp, Homo sapiens
agaagaaaaatcaatgaatccgtattcagcagaagcaccctgttggtctcaattgtccaatgctgagctatcagtttccctcattgaacacagtgcctggtacatttacttttttaaagtgcactctctggataacaaaaaaagaaagataacaagcatcaatactgtaggaagtcccctgtacaagctttctgataaacaaaagttaagaaaaaaatagatcgagcttttccttagtgtggtgtttagaatgagttcagaataatattctcaatactgtaactctctctgcaacatctgtgtaaatttcctgaacagatctttaaatatattgtttcctttactttctttatttctggcacttatagttatcataaaatctggatatagtcttcaacagttttcatctttattcatatacagggtgttgtaatacatgatataagcaaggctgtataatattaaaataatttgtatcacagttaagagagaaaatatatatcaaggaggaaa

SEQ ID NO: 74175 - DNA, 420 bp, Homo sapiens
ttactagggaaattttcaagcatgcaaaagtagatggaataatatactcgatcctcatatacacatgaccagttatcaacatatggccagtcttctctcatgtccttcctatttcattgcatcagtcactccatcagtgtttagtctccctgcttgtctcatcagtgttttcctccagttggtgtgcgtgcaacagggaccaaacaagatccccacattgtatttggttgccatgtcccttaagtctcatttatcctatagtttgccctctcctttttatttccacctgaacttctcccgccacaaccttttaattagaaaatacacaaacctatggaaatgagttgaaaaacagtatattgaacgctgcttacccttcatctatggtcaccagatgttcacattttgccttagtttatg

SEQ ID NO: 74176 - DNA, 278 bp, Homo sapiens
ttacaactctccctgccccctccaagaggaatgtgagcacccagcaaatcaaatctctagaccaagcgggtgagctggacaagagcgcaaaggtccaattaagctgcctggccccttgcagcataacacgccaggaagccagaagaatgagtcttaaccctgttccttcctccacccacctgcatgtatttaccagcaatgacctggctgttgtcttggttttctttaaacagtttggagttttgtttttttaataaagatttttaaataatagatta

SEQ ID NO: 74177 - DNA, 301 bp, Homo sapiens
aaatgaaccatttagtcatattccatataattttcttaactgaagaaaaatgtaaatggaatccacgtcggatacaggctttctttatattctaaatctagttgtggttgtttttaatggtatttaagaaaatagttggatgtttgggataacactttgaattgttgattgtttttcacaattttggagagaacttatagtgtttctattttatgttggttttcattcaaagtaagtttttacattaaacagttgtcccttggtattcgtgggggattggttacaggacctcttgaggata

SEQ ID NO: 74178 - DNA, 1278 bp, Homo sapiens
  misc_feature (191)..(191): n is a, c, g, or t
  misc_feature (951)..(951): n is a, c, g, or t
  misc_feature (1142)..(1142): n is a, c, g, or t
ctctgaccaacactactgatggccacttgtagctactgtattctccccataccatccattttgtcacttaatatgccacctcatcgtgtatccctgtgattttctacagatcaaacctattacatcacgaagttatgccaagattaaaacagttttaatgctaaatttaaaaaagtatagttgtctaaaanttttttaatacttactactattggtcagattgatggaataactgatacaaaacaaaaactggtcattgaaacacaaattttggagatgaaacctaatagtgatgcagtgtatgtaaaaggtacgtgatggtctctgggccatactgcctgggtttgaatccaggcttcgctaagtatcagctagatgaccttgagtaagttacttaatctcaaatctcacatctgtaaaataggagtaatagttcttacctatttcaattgttgtaaagattaaatgagttaccacttgaaaagaacttaaaatacctggcatatgtaaagtctagttgctagctattattttggtggttattaaaatattattcatccctgtttacctagcaatttctataaacctgccttacagaaacacttgcacaaatacacaaagacacatatgactaacatttttagaggtgggtggatcacttgaggtcatcagtttgagaccagcctggacaacatcgtgaaaccctgcctctactaaaaatacaaaaaattagctaggcatgttggtgtgtgcctgtaattccagatactagggaggcggagacaggagaattgctgaacccggaaggcggaggctgaagtgagccgagatcgcgccactgtgctcctgcctgggcgacagagcaagactccatctcaaaaaaaaagctaaagacaaccgatatgtctataagtagtaaactagtgagtacatcatcatatatcatatganatactgtgaatgcacactaaacagtgaaggaactcttttgtatataagataagatctatttaaaaaaaaactacaatatgcactgatatggtttggctgtgtccccacccaaatctcatcttgaattgcggttcccataatctccccatgtcattggagggacctggtaggaagtaattgaatcatggggnacttcccccatgctcttctcatgacagtgagtgagttatcatgagatctgatggttttataaggagctttttcccctttgctcagcatttctctttcctgtcaccatgtgaagaagcacgttttcttccctttctg

SEQ ID NO: 74179 - DNA, 452 bp, Homo sapiens
gctaagtttattaaaaattaggatagaatattcttcctatcaaagggctctggagtgtctattatgagattcctgtctatttccctttctcctccattattaaaaaattcataatttacattggtgtcatattaatgcaaaacaacaggttttatgatttttgccattttagtatagtcattcttacattttgtttccagcttttaaaaataatttttgccatcagttgagtgaataggacaattatgatgtcagtaatatctgtgtgtgtgtgtgtgtgtgtgtgtgtgtgtgtatgtgtatacaatatgtttagtcaaccccattctagattttctcaaacaagacagtaaaactaaatggcagtgttcatgggatttattgagtaaatatattttaagtagatatacacgcccaatattagcaatagcaggaaatgaaaaaggagtaaa

SEQ ID NO: 74180 - DNA, 455 bp, Homo sapiens
tgtctggggtttgtgcccgctttcctgtttctaatgttccctgaacctacctctacagtagcaaccatattccattatacagtatttacttattgacccatccctcttccctgccagaccttgaactccctgagggcaaaaaccttcccattctcaatctctgccacctaacatggcctggcagtttacgaacgaacaaatgcttaaatattaacttattgatcattgaatgaatgaatgaatatctaaatcctgttgtctatttttaaacacagggacaattctcatatagtctaacatctgtatgataaaaagtataaagatggcattaagaaaaacagaaagaatatgtaccagaaaggcttaataatggttattacatttcttaaaatatattttctatgttataaatgtactcattttataataaaaacctcaatataagataaatagta

SEQ ID NO: 74181 - DNA, 291 bp, Homo sapiens
ggcagaggtcacagtaagccaagatcatgccattgcactacagcccgggtcacaagagtgaaactgcatctcaaaaaataaataaacaaataaaaataaaagaattgagaacttgttacaggcttgccacattcttcacacttgtagggtttctgtccagtatgaattatgtgtaataagggttgagaacttccttaaaaagctttgtcagccaggcacagtggctcatgcctgtaaccccaacactttgggaggccaaagcaggcagaccacctgaggttaggagattga

SEQ ID NO: 74182 - DNA, 392 bp, Homo sapiens
ttacttcggcgtggtggtgcatgcctgtagtcccagccacctggaaggcagaggctgcagtaagccaagatcgagccaccacttcagcctgagtgatggagcaagactttctcaaaacaaacaaacaaacaaaaaccccaagggttatcaaccccaattcaagactccattactttattattcaataagactcacaatgttgacgagaactaatctacaagtgattaagaaaataaaaataaaacaggcttatggtgatgattggccaagtaaataaacacgctccatcatcatcacagtgttcagaacaggcttccagggcaacactggccagaagtgaggagaaattaaagttccactggtaaaaccatgtaacttaaaaaaaaagccag

SEQ ID NO: 74183 - DNA, 450 bp, Homo sapiens
aacaatgctgctatgaacattcgtatatgggtatctgttcaggtctctgcttccagtttcttttgggtctgtacttagaagtgaaattgccgaatcgtatggtagttttgtgtttaactatttaaggaactgctgtaaatcctttgaagccattaacagttttgaagaaatttagcaaatttatttatttagcaagtgtttattaagtgcccaccacgtcctgtgcacatcatgttctaggcactttgccaaaacatttctccttgtcttctgcgcagaaagacgatgccaactgagtgtgttctccactgagtggcacagaggcttttaacacatggggcagcagaatgacacagggaagggatgactgtcttcggagacattcactcactgcggttgctgttgacagtcagtgattctctgctcggggtgttcagggacagatgcctt

SEQ ID NO: 74184 - DNA, 729 bp, Homo sapiens
actccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaatgcttcctggaggtagctgtgtcttacctgagacttggcaggaggcagtagggcctgagggaacagcatttacagtgtcctaacggttatactgaaactttccacgtatacttgatggaacatcaatctgaaggcatcctacacttcctccatcagacctgatggtgcaagtgaacaccatcagtgcctttccagtttcatcaaagcagttattttag

SEQ ID NO: 74185 - DNA, 6630 bp, Homo sapiens
  misc_feature (1)..(2): n is a, c, g, or t
nngaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggtccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74186 - DNA, 6673 bp, Homo sapiens
  misc_feature (1)..(2): n is a, c, g, or t
nngaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggtccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaaaaaaaaaaccagatggagatatagcgattaggcctactatcct

SEQ ID NO: 74187 - DNA, 7290 bp, Homo sapiens
gtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggctgtactcaacggtggcttggtgtttaggggatttaaggggggcaaaaagaaagattaataatctcctcctctccctctaaccctactgccctaagatatccttagcaaacttacatctcctttcttttctctgtgttcattccattgtgcgcacacatacacattcatggattttctctttttgtttagggaaaaaaattataatgtacatactattctacaactttttgttgttttattgaacattatatgattcctaaattatccccaggtgaatacaaatagatatgacacattttaaaaaaataaaataactggccgggcgtggtagctcatgcctgtaatcccagcactttgggagcccgaggagggcggatcaggagatcgacaccatcctggccagcatggtgaaaccccatctctactaaaaatacaaaaattagctgggtgtggtggcgtgcgcctgtaatcccagctactccggaggctgaggcaggagaatcacttgaacccgggaggcggagattgcagtgagctgagatcacactgcactccagcctgattgcagtgagccgagatcatgccactgcactccagcttggcaacagagcgagactccgtctcacaagaaaaaaaataaccgggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaaaaaaaaaacaagaatctgaattcttaaaaaaaaaaaag

SEQ ID NO: 74188 - DNA, 6590 bp, Homo sapiens
  misc_feature (1)..(2): n is a, c, g, or t
nngaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggtccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaaaaaaaaaacaagaatctgaattcttaaaaaaaaaaaag

SEQ ID NO: 74189 - DNA, 862 bp, Homo sapiens
gtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggctgtactcaacggtggcttggtgtttaggggatttaaggggggcaaaaagaaagattaataatctcctcctctccctctaaccctactgccctaagatatccttagcaaacttacatctcctttcttttctctgtgttcattccattgtgcgcacacatacacattcatggattttctctttttgtttagggaaaaaaattataatgtacatactattctacaactttttgttgttttattgaacattatatgattcctaaattatccccaggtgaatacaaatagatatgacacattttaaaaaaataaaataactggccgggcgtggtagctcatgcctgtaatcccagcactttgggagcccgaggagggcggatcaggagatcgacaccatcctggccagcatggtgaaaccccatctctactaaaaatacaaaaattagctgggtgtggtggcgtgcgcctgtaatcccagctactccggaggctgaggcaggagaatcacttgaacccgggaggcggagattgcagtgagctgagatcacactgcactccagcctgattgcagtgagccgagatcatgccactgcactccagcttggcaacagagcgagactccgtctcacaagaaaaaaaataaccgtgtgagtactattccatagaat

SEQ ID NO: 74190 - DNA, 885 bp, Homo sapiens
agtggttgttgcgtgtgtgggtggttgatgtgttgtgttgttgtgttcgttgatgtgttggttagtttgttgtctgtgtgctgtgtgtgtgtgtatggtcggtgtgtatgttatgagcgacgctgagagaagtggccgaagaatagttcgggagcccagaagtcttagccaccgcagggcatatgccgccgtggggtacaccacagataacccccgaaaaagggttatagtttgtcctccggggccactataaaactcgctgaaggagagggggccccacaacaagttgggcccccacgcacagaggaagatgggggctcctctctccaacgagagttcccaggagggacccagctgtgttccacgccaacgcgactgtgtttataaacgcggcggcccgtggcccctgggcctgataataatacgagaccgcccctataaggggggcccgccctggtgaaaaaaaaaaacgggggagcgcggctaatggggccccccggggggaattttttggccccccccctttttttttttttttttttttttttttttttttttttttttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaaaaaaaaaacaagaatctgaattcttaaaaaaaaaaaag

SEQ ID NO: 74191 - DNA, 695 bp, Homo sapiens
ctccagcagaatatctcccgagagcttcatcagtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcttatctcgaggagataagcaggatttttgaccaagtagcttaaaagccagcaaaacagggatcagtgacagcaactgtagtgtatggagtatgaaatgacaaactttacacaaatacactgttagaaatttaccagtgaacactgaagatctgagaagctgctctttggaacagtcaagtgggaccaccttattccagtcacataagcccttgtaaagtaacacagtgttctgtgctatatacttgctggctgggtagttacaggatttgttttgtcattagcagctgaaaaacttattccacatgttcttaaagccttaatggtggaaaaaaaggcaagtgtcattagcatggtggatcatatacttctgcacacaaacacaagaggcttcactagtatttttaaagtctctgatgtctcccattgcacttcaaagctcaattgagatgaaagcctttctccatcgtagcagctagcaggcgctctcctgctatct

SEQ ID NO: 74192 - DNA, 6487 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74193 - DNA, 6409 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74194 - DNA, 6351 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74195 - DNA, 4454 bp, Homo sapiens
  misc_feature (7)..(7): n is a, c, g, or t
ctgactnagaggatccctcgaatcgacggttctcatccaaaggttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacagttaagacgtctacttttggtgccttttttggggggggggggtcctcctaactcctaagtggaggtggctcttgctgtcatgcgagttattcctaggctttactcttagcctcgagagagcagtaactgggacactagatgtaagaaggaaaagatgactcacacgacaagtagagcttgatctccctgcccacggtgaatatggtggacacagcctcagctttgtggtgctgacacagcctcttttccccacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74196 - DNA, 3986 bp, Homo sapiens
agctcggtacccccccgactagcccgacagtccccagaagcacagcctaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74197 - DNA, 3949 bp, Homo sapiens
cactcttgaggatccccgtgagaccacctttgcgaaggatagtatatttgaacctgctaagggaggagaaaagctccaaataaaaaagactgtgtcattccatctgtatatcaggtctgtacagttcctgttgctgccagggtgggccctgccaggctgttagaattgggtatccaaatgctctcctggcctgtaaatcgaacctgatacaataagccacactccactgtgggtttgaggtccatattcaggcgtagataactcacatgtactgctgtccacctccagtctcccatggtaggccttagaaaacatcccttgcctctgtcacatctgactgttttggagccccacgaaattgcagatttcccacaggtgagttttaacagccacccctgtttttcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74198 - DNA, 6425 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcaccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74199 - DNA, 2816 bp, Homo sapiens
ctctagaggatcctcgcgaaacgtgtaatcccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74200 - DNA, 2309 bp, Homo sapiens
ggacgcgtgggtcgaaccacgcgtccggagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74201 - DNA, 6526 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaacctcgtgccggggtaaacagcgtggctcgttggtggtcg

SEQ ID NO: 74202 - DNA, 6297 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74203 - DNA, 6464 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaaaaaaaaaacaagaatctgaattcttaaaaaaaaaaaag

SEQ ID NO: 74204 - DNA, 1629 bp, Homo sapiens
caaagggaagaagggacccccgcgggcgttttaaaatggacgattttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74205 - DNA, 5975 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagcataactcggacgtctgcgtgccgaccgca

SEQ ID NO: 74206 - DNA, 1544 bp, Homo sapiens
gctggacggtaccagaggcactgtggatgggccacggaatgaattgtcccgggtctccaaaaagaacatttttcttctgcccactgttatcttcactttctttgtccagtcttttgttttaataagcagtgaccctcctactcttctttttaatgattttgtagttgatttgtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74207 - DNA, 5401 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74208 - DNA, 4871 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcgactctccgaaggcgcggggtggggggacaataatctaagaactgaaggcagagactttctttagaatctttgttcctgtctgcaattataggattttcatgtgtcagcaaaggatagggtgtctctagttatttgtttccagggccatcg

SEQ ID NO: 74209 - DNA, 614 bp, Homo sapiens
tcatagccaaggaggtattccacctcctaccggaatataattaaagggagaaatacactgtatgaagatacatgttaaggcttaaggtgtaaacactttggaaggcaaacagcttagtgaaaaaaattatggttcatttaaaaatgtgtatcatttcataatagacccctgaactttcaaatttacatgtgagaataccacaccacttgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74210 - DNA, 2916 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagccgctccgtgtggagatgcgccctcctacatccgctatctcctgaccggg

SEQ ID NO: 74211 - DNA, 616 bp, Homo sapiens
cccagttcgctagtcaaacctgtgagttcaacatgatagagcagagtggaccaccccatgaacctcggtaagagaccacccaggaactgtacctagggttggggtcaggtgcttttgctcctgacgcagtcttggctgatttgtgagcagtgctgtttggtggcgcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctggccaacatggtgaaaccctgtctctactaaaaatacaaaaattagctgggcgtggtggcgtgcacctgtagtcccagctactcaggaagctgagacaggagaatcacttgaacccaggaggcagaggttgcagtgaactgagattgcgccactgcactccagcctgggccacagagcaagactccatctc

SEQ ID NO: 74212 - DNA, 6533 bp, Homo sapiens
  misc_feature (1)..(2): n is a, c, g, or t
nngaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggtccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaaaaaaaaaacaagaatctgaattcttaaaaaaaaaaaag

SEQ ID NO: 74213 - DNA, 7252 bp, Homo sapiens
gtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggctgtactcaacggtggcttggtgtttaggggatttaaggggggcaaaaagaaagattaataatctcctcctctccctctaaccctactgccctaagatatccttagcaaacttacatctcctttcttttctctgtgttcattccattgtgcgcacacatacacattcatggattttctctttttgtttagggaaaaaaattataatgtacatactattctacaactttttgttgttttattgaacattatatgattcctaaattatccccaggtgaatacaaatagatatgacacattttaaaaaaataaaataactggccgggcgtggtagctcatgcctgtaatcccagcactttgggagcccgaggagggcggatcaggagatcgacaccatcctggccagcatggtgaaaccccatctctactaaaaatacaaaaattagctgggtgtggtggcgtgcgcctgtaatcccagctactccggaggctgaggcaggagaatcacttgaacccgggaggcggagattgcagtgagctgagatcacactgcactccagcctgattgcagtgagccgagatcatgccactgcactccagcttggcaacagagcgagactccgtctcacaagaaaaaaaataaccgggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74214 - DNA, 6741 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacagttaagacgtctacttttggtgccttttttggggggggggggtcctcctaactcctaagtggaggtggctcttgctgtcatgcgagttattcctaggctttactcttagcctcgagagagcagtaactgggacactagatgtaagaaggaaaagatgactcacacgacaagtagagcttgatctccctgcccacggtgaatatggtggacacagcctcagctttgtggtgctgacacagcctcttttccccacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74215 - DNA, 6779 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcaggtctgtacagttcctgttgctgccagggtgggccctgccaggctgttagaattgggtatccaaatgctctcctggcctgtaaatcgaacctgatacaataagccacactccactgtgggtttgaggtccatattcaggcgtagataactcacatgtactgctgtccacctccagtctcccatggtaggccttagaaaacatcccttgcctctgtcacatctgactgttttggagccccacgaaattgcagatttcccacaggtgagttttaacagccacccctgtttttcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74216 - DNA, 4156 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccgctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74217 - DNA, 6433 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74218 - DNA, 2977 bp, Homo sapiens
aaagcaaggctgtacgcccggaattagggatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74219 - DNA, 6522 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaaacactcggcattatttgttttcttcttttcttctt

SEQ ID NO: 74220 - DNA, 2064 bp, Homo sapiens
tctagaggatccctgtggagccttaaccctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74221 - DNA, 1471 bp, Homo sapiens
tcggctaggtggaggctgggtgttaatcggccgaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaa

SEQ ID NO: 74222 - DNA, 5389 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacctggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcaggtggtgtgcaccacctgagtcacaccacctgagtcacaccacctgagtcctgtaagtaggagagtgatatttgatcaggagaacgtggttactagcacagagagttctcccagtaggttaatagtggggggtaaggcgaggttagcgaggcttgctagaagtcatcaaaaagctaatagtgggagtagagtttgaagtccttgagagaggattatgatgcgactgtgagtgcgttcgtagtttgagtttgctaggcagaatagtaatgaggatgtaagtccgtgggcgattatgagaatgactg

SEQ ID NO: 74223 - DNA, 4550 bp, Homo sapiens
  misc_feature (17)..(17): n is a, c, g, or t
  misc_feature (24)..(24): n is a, c, g, or t
  misc_feature (26)..(27): n is a, c, g, or t
gggggggggagggctcncggccgnannggcagcctccgggtgtccggccgtgtcccgaggaagtgcaagacccggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagagttcacgcgcagatatacgtcgcgaggggtctcaagagcagc

SEQ ID NO: 74224 - DNA, 424 bp, Homo sapiens
ctcacatgttcaagagaagtgttcctggaagaggtgaaactaggttgatgcttaaatgttgaaaggggtcagccaggctaagagacactggctgttcaaggcagaagtgactgcatgagatgtgactgcacagaggtgatgtgttcaaggaaattaccagtagtggaggatggcagcctggcagaggctaggtcaggctcctcagtcaaaaccattttaatccttctacgtgcttcatctcctgtcaggttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtagggcgttttcctactcaaaagatacagg

SEQ ID NO: 74225 - DNA, 364 bp, Homo sapiens
atagactgttacttgtagatttccatgtaatcattgaggttatcacccagattagaaagacatatttgttatcagtgtacattctaattgagagcatatatccagtagtatcaaacaataatgtctactgtttatagtccacttaataaaaatagaagcatttaccatttgccttaggctgataggaatgtgaatattcttgaccaaatatatcagcatctaattgaaatgaccaaatagcattcttagacttctgtattatgaatataattgatatttaaattaatgtcttgttcatatatgtgtactttcatatttgattttaaaatatacattataacctgtatggtattttatttaaagg

SEQ ID NO: 74226 - DNA, 498 bp, Homo sapiens
ttgctgtgatcttgctgtaaactccatgggattgttctttaattcagggccttatcctgtcataaaatatgagataagaatgtgctgcgaagcactagactggctggaagcctgcccccatacatatctcattaaatccttaaaggaacacgggcaaaagataaaccaagggcaagaaaacctgcagtcgcgaaggcaacacggcccattagtaagtgacagagccgatctagagtacagagccactcaacccataataggcgcaaggcggtctgctttgcccgcagcgctccggaacacccggctacgggatagcgatccatccttggggctcggcggagcgagtggtagtgggcaacacaggtaacaggcaaagccaaccaccaaccgagagcggaagtcggggaacctagccaataagagtgcgggcaattttctgtgcttcacaatggtgggttctttccagtccgctggagacaaaggcggggcaacgttggg

SEQ ID NO: 74227 - DNA, 2211 bp, Homo sapiens
ttttttttttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaa

SEQ ID NO: 74228 - DNA, 2244 bp, Homo sapiens
ggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaa

SEQ ID NO: 74229 - DNA, 601 bp, Homo sapiens
  misc_feature (13)..(13): n is a, c, g, or t
  misc_feature (34)..(34): n is a, c, g, or t
  misc_feature (70)..(70): n is a, c, g, or t
cccatccccacangggggtgtgagggattaaagnagatggagggatgtggagcacctagataagtgcccngaaacattgaaagggcctcaagaattgtagttcctgttgtattaccttaatgtccataatagaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaa

SEQ ID NO: 74230 - DNA, 1260 bp, Homo sapiens
  misc_feature (216)..(216): n is a, c, g, or t
gtccattcgatctgctttccttcgtgcgctgttgtgtctgtggcgcgtcggctgtgggggttagtctggtgtcgtggtctgggctcttctgggttgtcggtaggtggtcggcgggaggttcggtggtgtctcggtcggtgttgtaggtggggtgtggtgcggtttgcgggcgtctcttgtggtcggtggtgggtgctgctcgggtggcggtgctgnagattgttgctattggcaacgtgcctcgtattctcctgagacaggttagattgcatggtgcatgagggctcttgcagcccattcccgtgtgacttggataccgggcgctggtctcgccgatgggactcttgattccgcagacagcgtggccttggtacccatatggagcttgcctgcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaa

SEQ ID NO: 74231 - DNA, 917 bp, Homo sapiens
ggacaccccagcccaccgtggtcatgtacccaatgatgggagcctggcccaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaa

SEQ ID NO: 74232 - DNA, 3275 bp, Homo sapiens
ggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagagagagagagagagagaagcgggcggggggggggggcgggcggattgcactggggagggaggacttgtgtgagcggcgctgcggtgggagtgtctgtttagtaggtgagagagggtgcggtgaattgaggagggaggaggatagtgatagagaggaagagggggaggcggatgaacgaactagatatttataaccagcaaacatcatgatcgcagaatagccaattatataattatttgtgggaacagtacaacatatcccctctatttaatgactatcaaacatggagacatagcaaaaatacacacaaaaatatattaacaataatcaactatctacagaattaagacaaataataagtaaattagataaaaatatactattaatctacacatagttgtcaaaaaccagccgctgcatatacatatctcacaatacagcatctatagtcaaacacataaataactaaatactataataaagtataaatttgcagagcaccatatcatatatcattaacaagactgtcgaggtggccgcatcttatggattagaagggccaggcggagacaggatagagcgaagaagaagcatggacctgatgtaggggaggaatagagagaggacgagccgggagtgcaatgccacgatgagaacacatgcaagaatacggaggacgggggatggagcttagggacgggagtaggagggaaagggtgaggaagtgaaggagggtaggagatgatagggaagagagaagaaaggaggatgtgaggagagaggggtggaaagagaggagagatgggcatgaaatcgaaggagtaggaagtggtcgaaaatgagataagatagagaggggaggaaggagtaaggagagggagaaaggtgaagagtgaggaagaaagtggatagaggagagaggaggagaggaggtggagcgtggtga

SEQ ID NO: 74233 - DNA, 3221 bp, Homo sapiens
ggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaattctgaggccttgatttaaatctttcattgtattgtgatttccttttaggtatattgcgctaagtgaaacttgtcaaataaatcctccttttaaaaactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagagagagagagagagagaagcgggcggggggggggggcgggcggattgcactggggagggaggacttgtgtgagcggcgctgcggtgggagtgtctgtttagtaggtgagagagggtgcggtgaattgaggagggaggaggatagtgatagagaggaagagggggaggcggatgaacgaactagatatttataaccagcaaacatcatgatcgcagaatagccaattatataattatttgtgggaacagtacaacatatcccctctatttaatgactatcaaacatggagacatagcaaaaatacacacaaaaatatattaacaataatcaactatctacagaattaagacaaataataagtaaattagataaaaatatactattaatctacacatagttgtcaaaaaccagccgctgcatatacatatctcacaatacagcatctatagtcaaacacataaataactaaatactataataaagtataaatttgcagagcaccatatcatatatcattaacaagactgtcgaggtggccgcatcttatggattagaagggccaggcggagacaggatagagcgaagaagaagcatggacctgatgtaggggaggaatagagagaggacgagccgggagtgcaatgccacgatgagaacacatgcaagaatacggaggacgggggatggagcttagggacgggagtaggagggaaagggtgaggaagtgaaggagggtaggagatgatagggaagagagaagaaaggaggatgtgaggagagaggggtggaaagagaggagagatgggcatgaaatcgaaggagtaggaagtggtcgaaaatgagataagatagagaggggaggaaggagtaaggagagggagaaaggtgaagagtgaggaagaaagtggatagaggagagaggaggagaggaggtggagcgtggtga

SEQ ID NO: 74234 - DNA, 2237 bp, Homo sapiens
  misc_feature (216)..(216): n is a, c, g, or t
gtccattcgatctgctttccttcgtgcgctgttgtgtctgtggcgcgtcggctgtgggggttagtctggtgtcgtggtctgggctcttctgggttgtcggtaggtggtcggcgggaggttcggtggtgtctcggtcggtgttgtaggtggggtgtggtgcggtttgcgggcgtctcttgtggtcggtggtgggtgctgctcgggtggcggtgctgnagattgttgctattggcaacgtgcctcgtattctcctgagacaggttagattgcatggtgcatgagggctcttgcagcccattcccgtgtgacttggataccgggcgctggtctcgccgatgggactcttgattccgcagacagcgtggccttggtacccatatggagcttgcctgcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaattctgaggccttgatttaaatctttcattgtattgtgatttccttttaggtatattgcgctaagtgaaacttgtcaaataaatcctccttttaaaaactgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagagagagagagagagagaagcgggcggggggggggggcgggcggattgcactggggagggaggacttgtgtgagcggcgctgcggtgggagtgtctgtttagtaggtgagagagggtgcggtgaattgaggagggaggaggatagtgatagagaggaagagggggaggcggatgaacgaactagatatttataaccagcaaacatcatgatcgcagaatagccaattatataattatttgtgggaacagtacaacatatcccctctatttaatgactatcaaacatggagacatagcaaaaatacacacaaaaatatattaacaataatcaactatctacagaattaagacaaataataagtaaattagataaaaatatactattaatctacacatagttgtcaaaaaccagccgctgcatatacatatctcacaatacagcatctatagtcaaacacataaataactaaatactataataaagtataaatttgcagagcaccatatcatatatcattaacaagactgtcgaggtggccgcatcttatggattagaagggccaggcggagacaggatagagcgaagaagaagcatggacctgatgtaggggaggaatagagagaggacgagccgggagtgcaatgccacgatgagaacacatgcaagaatacggaggacgggggatggagcttagggacgggagtaggagggaaagggtgaggaagtgaaggagggtaggagatgatagggaagagagaagaaaggaggatgtgaggagagaggggtggaaagagaggagagatgggcatgaaatcgaaggagtaggaagtggtcgaaaatgagataagatagagaggggaggaaggagtaaggagagggagaaaggtgaagagtgaggaagaaagtggatagaggagagaggaggagaggaggtggagcgtggtga

SEQ ID NO: 74235 - DNA, 623 bp, Homo sapiens
gcggccgcctactactactaaattcgcggccgcgtcgacaacaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggaggctgtgtctactattaaaagtgaaacattttggcatgtttgttaattctagtttcatttaataacctgtaaggcacgtaagtttattttatttttttgtaaaacaatataggctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcaaaaaaaaaaa

SEQ ID NO: 74236 - DNA, 2035 bp, Homo sapiens
ggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagtgtaactggagctgttgtaacagaggctaggagggatcctgctagtgtcgacgggaaaacacgcgggttta

SEQ ID NO: 74237 - DNA, 3762 bp, Homo sapiens
gctgctctgggtgcacgtccacttggacttgttctcttcatagtgagcactggtcttaatgtatctggccagctctatctgcatgtcgccgaaaaggggcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74238 - DNA, 3893 bp, Homo sapiens
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctgggtagtagcccctgacccaggggcgagggtcggcgcggttggcccgagaaggggtcctttccccgcatggggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74239 - DNA, 3694 bp, Homo sapiens
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74240 - DNA, 3532 bp, Homo sapiens
gctgctctgggtgcacgtccacttggacttgttctcttcatagtgagcactggtcttaatgtatctggccagctctatctgcatgtcgccgaaaaggggcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcaagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74241 - DNA, 3317 bp, Homo sapiens
gctgctctgggtgcacgtccacttggacttgttctcttcatagtgagcactggtcttaatgtatctggccagctctatctgcatgtcgccgaaaaggggcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggcgtcgacgcggccgcgaatttagtagtagta

SEQ ID NO: 74242 - DNA, 3890 bp, Homo sapiens
gctgctctgggtgcacgtccacttggacttgttctcttcatagtgagcactggtcttaatgtatctggccagctctatctgcatgtcgccgaaaaggggcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74243 - DNA, 3852 bp, Homo sapiens
agaaactttttacttacaggaagtgcccccccccccaaaaaaaagtgtttggaacattattacatacttgtatgtctgagcattcttagaatagtagaatggcctgcctcaggccatgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacagacgttaaccctctgggcgaagcattgatgaaagctttgataagccaaagtgcccctaaaaccaatgagaacaagaagagaatctgagtgcagaggcccctgggagctttgagggatacattgctcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74244 - DNA, 3639 bp, Homo sapiens
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgataaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74245 - DNA, 3554 bp, Homo sapiens
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74246 - DNA, 3640 bp, Homo sapiens
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggtttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74247 - DNA, 3232 bp, Homo sapiens
gaggactcagaggctgggatcatggtagatggaaccctccttttactcctctcggaggccctggcccttacccagacctgggcgggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74248 - DNA, 2760 bp, Homo sapiens
gctgctctgggtgcacgtccacttggacttgttctcttcatagtgagcactggtcttaatgtatctggccagctctatctgcatgtcgccgaaaaggggcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaaaaaaaaaaaaaaaaaaaaaaaaaaaaaaaaaaaaaaaaaaaaagggggggggcgcgtcacaaaatatatcccctcaggagggggcccaagagtctcagcggcgcgtaacacagagatttgctgggacacaagaggggcgcccataaagagcgggcgcgctataaaaaaaggcagaggacgcgggacgcgcaggttgttacacaaccgtcgagagcagtggaaacaacgccgcaatacaggggaaaatttagtgggaaggcaccctataccatcgcgaggcgggcacaacataatgtgggggcacaagatcccccacgacagcaattgaaacgcccgcagggagaacatgca

SEQ ID NO: 74249 - DNA, 2375 bp, Homo sapiens
tgcaaattccagctcggttccctgtgaagcacacccaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74250 - DNA, 1008 bp, Homo sapiens
  misc_feature (954)..(954): n is a, c, g, or t
  misc_feature (960)..(960): n is a, c, g, or t
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaatcattcangaaagnaattaataggacgatactttggtggaatcacgccagggcacggcccag

SEQ ID NO: 74251 - DNA, 587 bp, Homo sapiens
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgataaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggtaagaagtcaaacccagaacattttcatcgctccagaattctttccccgtacccattagcagtcagtcccccatcc

SEQ ID NO: 74252 - DNA, 489 bp, Homo sapiens
acgcagcaggtgcaggttcctaatttggacccatgtttattattacctctttgctttctgcaattctgcaagagaatagggcttcccttattcccttaccagccacctacacacatgcccatcccatgaacacaggtaatttaccttttggtttgtttccccaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaa

SEQ ID NO: 74253 - DNA, 2409 bp, Homo sapiens
gctgctctgggtgcacgtccacttggacttgttctcttcatagtgagcactggtcttaatgtatctggccagctctatctgcatgtcgccgaaaaggggcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaa

SEQ ID NO: 74254 - DNA, 3708 bp, Homo sapiens
gctgctctgggtgcacgtccacttggacttgttctcttcatagtgagcactggtcttaatgtatctggccagctctatctgcatgtcgccgaaaaggggcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74255 - DNA, 3487 bp, Homo sapiens
ccaaatggaatccccaaatggaatccttttgagattgagtagtattaactgctgtatgtaatattgctataaacatgggcatacagatatctttctggttttatatttacatgcccatgtcaaatgtgttgaaaagcttcacatagatatcattcgttatttccttattgggttcaaatttgtccataagagttacatgtttataactgaagtctataaattattccgtagaaggttttcccacagtgctaatagcatggtgagtggagtgaaagggcttgtatatatcctttcagagtttttttgaccttagcaaagctttgggattcaccgtgtggtacttgtgtttgcttttcaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcagaggttacaatcaaaagttttaaaattagttgatatatcctatggtggtgaaaatggattcaaccaagctattgagttatctactgaagtcctctccaacgtgaaattcattcaagagaagaaattaataggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaagaggagaaaattctctatctaactccagagcaagaaaaggataaatctcatttcacagacaaagagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74256 - DNA, 1652 bp, Homo sapiens
aggtcgtactagaggatcccgaacgcacgatagcccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaataaaaaatg

SEQ ID NO: 74257 - DNA, 1011 bp, Homo sapiens
agcgggtcacaggccccatgtgagcggattgcaacacatgcagctgcctggagagagggagccggtgtcctacgtcagagccgccgccgccgcggagccgccgccggggaggagcagccgctgccgcccaggactgggcccttagggaggaggaggcgagaagatggcggacgaccccagtgctgccgacaggaacgtggagatctggaagatcaagaagctcattaagagcttggaggcggcccgcggcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggctcttacagcactactttcagatgatagcaagtttggattcattgtaatagatggtagtggtgcactttttggcacactccaaggaaacacaagagaagtcctgcacaaattcactgtggatctcccaaagaaacacggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcaggtaagtaagaagtagatgctttattatgtaagaccctaggtaggagtaggtgaatacagcgatgaccatgtgtgctgcgttcgagctcgggtctactctagagtcgcagcgcagcg

SEQ ID NO: 74258 - DNA, 423 bp, Homo sapiens
cctttccttctcatctacttcactttcctaaaaatcaattttaagctagacaaaaaatgtgcagagaccaactttaagtggatccaaggcagtaatttgagctgattccatcaaattatagatgcatgagaagcatgcattttctaaagaataacaacgctgcaacaaacatttttgaaggaactactaaaatatttccatctctaaactcatcctcttccacttcagatgatttcttttccatttcattctattctctgaagcaaaaaccagaggaaagaaatctgatggaatgaaattctgctagcaaccatctgaaagtataaatgagggagaaagtccaagatttaaaaattcaagcaaattttcttgcctgttggaaggaagagctctcaaataaagagataatcaagagacatatta

SEQ ID NO: 74259 - DNA, 6634 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta

SEQ ID NO: 74260 - DNA, 6636 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttcttaagttggtgcgtccttcggatgataaatttaggaaccgaagtccaatcactgtaaattacggtagatcgatcgttaacgctggaattaaattgaaaggtcagaatcgactccgactctttcgatttcaaaccaaaactgtccaaaaggttttcatttctacgatgaagggtgacataccccctctaacttgaaaggggcagagggcagaagagcggagggtgaggtatggggcggttcctttccgtacatgtttttaatacgttaagtcacaaggttcagagacacattggtcgagtcacaaaaccaccttttttgtaaaattcaaaatgactattaaactccaatctaccctcctacttaacagtgtagataggtgtgacagtttgtccaaccacacccaagtaaccgtaagaaacgttatgacgaattaacgactatggtatacttactttgtacccgacactaatgacgttagtgacacgatagccgtctactacgaaaccttctacgtcttcgttattatttcatgaactgatggatgaccacattagagttacgttcggggttgaaagaataggttgaaaaagtatcattcacgcttctgactcggtctaaccggttaatttttcttttggactgatccaagacatctcggttaatctgaactttatgcaaacacaaagatcttagtgtcgagttcgtaagacaaatagcgagtgagagggaacatgtcggaataaaacaaccacgaaacgtaaaactataacgacactcggaacgtactgtagtactccggcctactttgaagagtcaggtcgtcaaaggtcaggattgtttacgagggtggacttaaacatatactgacgtaaacacccacacacacacaaaagtcgtttaaggtctaaacaaaggaaaaccggaggacgtttcagaggtcttcttttaaacggttagaaaggatgaaagataaaaatactactgttagtttcggccggactctttgtgataaacactgaaaaatttgctaatcactacaggaattttacaccagacggttagacatgttttaccaggataaaaacacttctccctgtattctattttactacaatatgtagttatacatatatacataaagatatatctgaacctcttatgacggttttgtaaatactgttcgacatagtgacggaagcaaatataaaaaaattgacactattaggggtgtccgtgtaattgacaacgtgaaaacttacaggttttaaatataaaatctttattatttttctttctatgaatgtacaagggttttgttaccacaccacttacacactctttttgattgaactatcccagatggttatgttttacataatgcttacggggacaagtacaaaaacaaaattttgcacatttacttctagaaatataaagttatttactatatattaaatttccttaag

SEQ ID NO: 74261 - DNA, 2441 bp, Homo sapiens
  misc_feature (2194)..(2194): n is a, c, g, or t
  misc_feature (2197)..(2197): n is a, c, g, or t
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcanaanacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaacc

SEQ ID NO: 74262 - DNA, 1291 bp, Homo sapiens
tgcaagtgttattcgacaaaagcaattatgctaatttccttccctgtggctcaattccttttttgacacgatgacttggaggagtcattatgattactccaaacaggaaagacactcgcccagctgtccgcccgcagagagctggctacggtgcagaaagctgaggaggcgtctggagtttttgggtgttaatgattctgcctgcccacaggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgacacttgctgaacatttcttttcaattcagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaa

SEQ ID NO: 74263 - DNA, 7625 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta

SEQ ID NO: 74264 - DNA, 7064 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttaaaaaaaaaaaacacaaacaaaacaaacaaacaaaacacaaaaaacaaaaaaacaaacaaaacaacacacaaaaacacaacaaaaaaccaaaaaaacaaaccacaaccacacaccaacaaaaaaaacacagaaagaaaagaaagagacggaagaggaagagagggggaggcgccgggcggcgaaaagacagagagaggcacgggggggaggagcggaggcgagaggagagaggggaagggcaaagagaccgagacagagggaaaaacacaaagaacacaagacagaaaaaggaaaagaagaacagaagggaagaaggaaacaagagcgaaaagaaagagagagaaagaaagaaccgaggagaagagagagagaaaggagcagcagagaagcaaagagaagagaaaagagaggagaaaagaacaagcgcacg

SEQ ID NO: 74265 - DNA, 6580 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgtagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta

SEQ ID NO: 74266 - DNA, 6580 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgaggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta

SEQ ID NO: 74267 - DNA, 6580 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta

SEQ ID NO: 74268 - DNA, 1220 bp, Homo sapiens
cttcctgcttctgccccccggggtgctgggattgcaggcgtgagctaccgcgacagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgggtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta

SEQ ID NO: 74269 - DNA, 3231 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaa

SEQ ID NO: 74270 - DNA, 3002 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttttaaaaaaaa

SEQ ID NO: 74271 - DNA, 2614 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccggatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaa

SEQ ID NO: 74272 - DNA, 1000 bp, Homo sapiens
aatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaa

SEQ ID NO: 74273 - DNA, 374 bp, Homo sapiens
agctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaa

SEQ ID NO: 74274 - DNA, 721 bp, Homo sapiens
tgttcattattttttatttatttttgtgtgactgagttatttctgagaagcaatctttgaggtctgagattcattcctcatcttggtctattctgctgttaatacttgtgattgtattattaaatacttttagcgtgtttttcagctctgtcagttcagtttggttctttcttaaaattatcatttcaactttcagctcctgtattgttttattgtaatccttagattctttggagttggtttcagtttcttctgaattttcatgatctttatttctatccatgttctgaattctttgcctgtcatttcagccatttcaacctggttaagcaccattactggaactagtgcagtcatttggaggaaaaagacactttggctttttgaattgccagagttcttgtgctgattcccatctgtgtgggctgatgttcctttaactgtggtgtagtttgagtgtagtcaattggctttgtttctggatgttttcagagggctgagactttgtgttgggtctttttttgtagctgaattattgtccttggttttatcggggcatgtattggcaaagtatttttagtgttgaagtttgggatgtgattcagtagatggtgcttaagcatgctggttagtagctgggcactcgctcagccaagtggctcttctgtatttcctcactccagcctgggcaacaagagcgaaactctgtctcaaaaaaaaa

SEQ ID NO: 74275 - DNA, 517 bp, Homo sapiens
caagtttcctcttttctgcttatgggctttatatgatttatagactctttggatttcttattaatattttaaagaagcttaaggaatataaatatatataggcttgaaaaatgatttctgtgatacgtattttagacctaagatttttacttttttagttgaatataatatgctcctagatcaacacctatatttagaaggactaaaatacatgtttttctaaaaaaagtgctttgcttaccatttcttcagcaatcattaggggatctatttatcaaactttaattgctttgctaattcaacagtttttaagatgtaggattttgattattgctatctcatgtttggtcatcatgtctttagttctgtaaaagttctgtaaaaatacaaaaaaattacctgggcatggtggcaatgggcctgtagtcccagctacccaggaggctgagaggtgggaggatcgcttgggcccagcaggcggaagttgcagtgagtggtgattgcactatcctgggcg

SEQ ID NO: 74276 - DNA, 354 bp, Homo sapiens
tttcattacccacccccactctgctgatttatggcataccatgcagagacctaaatcaaaactagaaaatacgtgtgaaataatgcaaaacagagtcgaagggttggcaattctgtaattatacctaaagggaaaataattatgtaataccatatggcaacagtcagtctcagaataacaaatgtccatactgtaaatgcaggattctgggaagagcacacagggtgtttgaagagaagctgaggacaagtttgccttttaaaaggacccatagacaactttgtgaatggtatttggcctttgatagtactgtttattagcccaggaaatgaaggccggagtgagtgaagtgac

SEQ ID NO: 74277 - DNA, 491 bp, Homo sapiens
ctgaaccataaatgtcatgcaaagaataaaatttaagaattaaaatgttgccctgtgtataatctcataaaatctttttaaagctagcaagaactctatttggatcagaactacattattacaaaacaaaatgaacacttgaccaaaaaaccacattaatttaaatggagcctttcattattttcagatagcggggtcttttccatttatagagaatgttgtaactgccaggacacttttgtgtttgcccaggactcctagtaagaattgaatcttgagggagtaatgataacaaaaggtttcttgtgactggtaacatcaggacagacagagtttttggtgagaagaaaatactatatgcctgcttgatagcatgtagagatcatcacatgtatggaaaccttaaaaagtaaacttattttttctaactagaaggctctcataagtttctgttatgattgccatttcaataaatgacattaaaaatctaa

SEQ ID NO: 74278 - DNA, 349 bp, Homo sapiens
ctccagcctgggcaacagagcaagactccgtctcaaaaaaaaaaaaagaaaagaaaaaaggaagctagaaaaacctttggggttttctacgttacttgtgccctacgttacttactacgagtagaaaccacattaaagtaaaagtcagaagacttgccctagtctcagctctgtgaagctcttaatagatagtaagatgaaagcttaaagaaattcccatttaggccagatgtggtggctcacacctgtaatcccagcactttgggaggccaaggtgggcggatcatggggtgaggagatcgagatcttcctggctaacacggtgaaacaccaaaccccgtctatacta

SEQ ID NO: 74279 - DNA, 338 bp, Homo sapiens
tgaaagtcttcttgggcaaaaataagggaaaaaaaagcaggggctagcttgcagaaaagttgatggtctgaggaattctcagattctgctgtttgtatgaactggctctgtaaccttgggcaggttactgatcttgcgaagcccagctttcctttttttacagcggagatggattcatctcatgggctcacggtggggcctgagcacagtgatgtgtgcaaggccctcagcaggatgccaggtacatgataagggccctgtcagtggtgaccactgtgacgagggtgccttaaaaaaggtgggcctccaggctgggcgtggtggctcaagcccgtaat

SEQ ID NO: 74280 - DNA, 912 bp, Homo sapiens
cggccgcggcgtgcactgtcggtcggcggctaaggaggggaggcacctgcatctggggcgcggcgaatcctcgcgtgcgccaggccgcctggggtagtcgccgagactgcgccggccagcggggccgaaacctaatcaggagctgagctttgatggcggcttctggagggacaaagaaggcgcagagcggtgggaggaggctgcgagaacctagctcccgccccagccgacgtgcgagacaaaggccccggcgcggggctcttcggaaggccgggaggttcctgtgacaatgcgagtctgcgccccacgctcccgcaccgtgatgccgaggccaaatggctagagtgggcccaggcatcagcatttctgtttggcagccgggcagttgtggtgcacgttttgaggaactactaaagcctgcctgtgatgaaaaaggcaaaagctgacttcaccaaaattactcccagggagacttctgcatttggctggaaggacatttgagtaaaccgctgaggctggtggttgaaacataatcctctaagggagatcggttccgataccctgagttagggacgcttgcctgggcagagctaaggggagaatgatcaaaagccaagctctgtccccgtcagcacgtcaccctccctcactgtaatccctgactgttttctctaaatgaagaattatttagagaatataaattagaagggccgccacgtcagaattgcctgagtgggagcagtctttccagcctcgaaaaatgtttaaacaatatgcagatgacctagcacaaataaagaatgctagcaaccgctgttatgtgtgagcggtggaattgggagggctcttcccccaatcttcatcaaacagagtaaggtttagaataaaaataatgaaatacagtctttcaaa

SEQ ID NO: 74281 - DNA, 480 bp, Homo sapiens
acattttgaggttgataactagttgaaactgatctgttttcccgacctcaacgtaattgcaaggtcacttcaagagggtaaggggctattgcaactacccaaattcgctattgtagtataaaagctttaattaacagcatgtataggaatgcaaagctatgttctaatgaaactttaaaaagcagacacaaatatgaatgtcatataattgtcatctgtcgcaaaactttttttttaacctttgaaaaatgtgaaacccatttttagctcctagtacagcagaacctgcggtgggctggatttgccctgagggctgtagtttgcccctgtggtacgtatgaaatgccacaattttaaaaagatgtgttacgtgtgggaccatttgtggggcggtttatgctaacttccaatacagtaatatatgtcaactcgcttttgagtgacatttagtctgggtggccatgcccaggaatggatata

SEQ ID NO: 74282 - DNA, 948 bp, Homo sapiens
atcatgtactctatcacctttgtgaatctggggcaccatccctatgtagatacactaatgtttctataacaaatgtttaaatattcacacacacatacacacacacacatatatatgaaaacaccctcaagactattcaaaaatttataatagagaattttatacgagaaatagttttcagctttatattttaaattgtgtttaaaaggactttttaaaatcaaagctcttcaatcccttttcatttcatgatttattttatctagtactttctttatggtttctagacttttgcagctacattctggactcagggaaaaacagataataattgggacaacgcaaaaggaaattcagattaacatttaaagtgtatatatatatataatgctatatatattttatatctataatgctatgtatataatgctatatatatatatcagctatatatatatatatcagaggtaagaaagtgatatatatcagaggtaagaaagtgatatcagaggtaagcagttagtaggccttttgactagaagaaagaggaaataaaaaaagtaaatatttcttagtaaccaagtataatatttaaaactgcccaaccaaagcccatgaagcaagtgaacaagttagttaaatgtttcttttggttttagccaaaagacaactctttcagaagacaaatgaatgtttaaatatggtatatacataaatataaaggtttaaaacttaatgcctcaggaaggggacgtgagtggaggatttttgggtgctggttacatgggtgttagttttttaagtttcctggatctgtactttctgatttgtgcacttttctgtgtatcagagttcaataaagagttctaaagccaatcaataattttgaaatttagcactgtactttaaaaaaataactttatctaggattggtgggttttatctttt

SEQ ID NO: 74283 - DNA, 385 bp, Homo sapiens
tttttttttttacaaaaagaaaacaagtgggaacatatggaaataatatcttttagtactccattatgatctttttttcctggagtaattttctggagagcaattctattgcttaatcaaaaagttttgatttttaaaagcatgttaatgaaatagactaggagaggaataaataagtaactgtttaagagaatacatcctagaccatggcaaagaactcactgatttcactaatgttaacaagcaactgtcaattcaatgaaaaaaacaaaacaaaacaagacaaaacaaaacccaaaagagtctgacaagctgacgagtcgtattggttcaaagggttaatcaggcacctcagatcagtcatagcttatttttgctacaagag

SEQ ID NO: 74284 - DNA, 415 bp, Homo sapiens
caaagcagatggagtgggtttgggcctttacagtggctgagcagtggggctgggaaaagttcctgcatgtgcacaatttaaattttccaatggtaccaaaggaggagatgaggtcatgggccttcttatcagcctgcccagatgcggggccaaaaaggaagagatggaaaggcctgaaaggaattattaatccaacatcaaaaatgaagtctgactctccgttacaatcaattataaagggaattagaaataaatagcacagaaaaccactttaaaatagtgaatctctaccatagcaaattgttactaatatatgaatgaatcaacaaaggcacaaatgtaccataaccccagtgactggtaaagggggtagccagcactttcataccattggcctgagggatttaatgtccca

SEQ ID NO: 74285 - DNA, 328 bp, Homo sapiens
ggctctgagacagtcctcctttcttgaggagacaaactccagcctgtgactgattgcagagtcttctggcaagcttcagagtaaaacaaaaactatttgtggatgacaaaggcttaaaatgggactgtggttaattttttgatggtaattttcggaagtgaaagaactgatgtgtctataacaggaataatgcaatcgacagaaaatttggttatttctgtgacacaaaggtaataaagttaatccacaaagttttaaacacaatgtatttaaagatagtcattatacagattttcagtgaagacagtgaatattacatctgatttac

SEQ ID NO: 74286 - DNA, 568 bp, Homo sapiens
aaaaaacaaaaagctagttctttgaaaagataaacaaaattcatagaccattagggagattaaccaagaaaagaagagagaagatccaaataagctcaattagaaatgaaacagaagctattacaatgtataccacagaaatacaaaagatcattcaaggctactatgaacaccttcacgtgcacaaactagaacacctttatgtgcattaactagaaaacctagaggagatgaacaaattcctggaaatacacaatcctccttgattaaaccagaaagaaatggaatctcttaacagaacaataacaagcagtgagaatgaaatggtaatttaaaaaactgccaacaaaaaaaagttcaggaacagatggattcacagctgaattctatcagaaattcaaagaatgggtaccaatcctattgaaactattacaaaagacagagaaagaggaaatcctccctaaatcattttatgaagccaatatcaccctaatatccaaaccagtaaaggacataacaaaaaactacagaccaatatccctgatgaacatagacacaaaaatcctca

SEQ ID NO: 74287 - DNA, 6088 bp, Homo sapiens
tattttggcagccttatccaagtctggtacaacatagcaaagagaacaggctatgaaataagatggcaagaaagaaatttagtggattggaaatctctctgattgtcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataatagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcagcccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaatccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccataattctgacggatatgaacatcaggatcctgcattttttgggcagaattcacttttggttaaatcatcaaggcagtatttaactattcgctacaccttattacccttcctctacactctgttttataaagcccatgtgtttggagaaacagtagcaagaccagttcttcatgagttttatgaggatacgaacagctggattgaggacactgagtttttgtggggccctgcattacttattactcctgttctaaaacagggagcagatactgtgagtgcctacatccctgatgctatttggtatgattatgaatctggtgcaaaaaggccatggaggaaacaacgggttgatatgtatcttccagcagacaaaataggattacatcttagaggaggttatatcatccccattcaagaaccagatgtaacaacaacagcaagccgtaagaatcctctaggacttatagtcgcattaggtgaaaacaacacagccaaaggagactttttctgggatgatggagaaactaaagatacaatacaaaatggcaactacatattatatacattttcagtttctaataacacattagatattgtgtgcacacattcatcatatcaggaaggaactaccttagcatttcagactgtaaaaatccttgggttgacagacagtgttacagaagttagagtggcggaaaataatcaaccaatgaacgctcattccaatttcacttatgatgcttctaaccaggttctcctaattgcagatctcaaacttaatcttggaagaaactttagtgttcaatggaatcaaattttctcagaaaatgaaagatttaattgttatccagatgcagatttggcaactgaacaaaagtgcacacaacgtggctgtgtatggagaacgggttcttctctatccaaagcacctgagtgttactttcccagacaagataactcttattcagtcaactcagctcgctattcatccatgggtataacagctgacctccaactaaatactgcaaatgccagaataaagttaccttctgaccccatctcaactcttcgtgtggaggtgaaatatcacaaaaatgatatgttgcagtttaagatttatgatccccaaaagaagagatatgaagtaccagtaccgttaaacattccaaccaccccaataagtacttatgaagacagactttatgatgtggaaatcaaggaaaatccttttggcatccagattcgacggagaagcagtggaagagtcatttgggattcttggctgcctggatttgcttttaatgaccagttcattcaaatatcgactcgcctgccatcagaatatatatatggttttggggaagtggaacatacagcatttaagcgagatctgaactggaatacttggggaatgttcacaagagaccaaccccctggttacaaacttaattcctatggatttcatccctattacatggctctggaagaggagggcaatgctcatggtgttttcttactcaacagcaatgcaatggatgttacattccagccaactcctgctctaacttaccgtacagttggagggatcttggatttttatatgtttttgggcccaactccacaagttgcaacaaagcaataccatgaagtaattggccatccagtcatgccagcttattgggctttgggattccaattatgtcgttatggatatgcaaatacttcagaggttcgggaattatatgacgctatggtggctgctaacatcccctatgatgttcagtacacagacattgactacatggaaaggcagctagactttacaattggtgaagcattccaggaccttcctcagtttgttgacaaaataagaggagaaggaatgagatacattattatcctggatccagcaatttcaggaaatgaaacaaagacttaccctgcatttgaaagaggacagcagaatgatgtctttgtcaaatggccaaacaccaatgacatttgttgggcaaaggtttggccagatttgcccaacataacaatagataaaactctaacggaagatgaagctgttaatgcttccagagctcatgtagctttcccagatttcttcaggacttccacagcagagtggtgggccagagaaattgtggacttttacaatgaaaagatgaagtttgatggtttgtggattgatatgaatgagccatcaagttttgtaaatggaacaactactaatcaatgcagaaatgacgaactaaattatccaccttatttcccagaactcacaaaaagaactgatggattacatttcagaacaatttgcatggaagctgagcagattcttagtgatggaacatcagttttgcattacgatgttcacaatctctatggatggtcacagatgaaacctactcatgatgcattgcaaaagacaactggaaaaagagggattgtaatttctcgttccacgtatcctactagtggacgatggggaggacactggcttggagacaactatgcacgatgggacaacatggacaaatcaatcattggtatgatggaatttagtctgtttggaatatcatatactggagcagacatctgtggttttttcaacaactcagaatatcatctctgtacccgctggatgcaacttggagcattttatccatactcaaggaatcacaacattgcaaatactagaagacaagatcccgcttcctggaatgaaacttttgctgaaatgtcaaggaatattctaaatattagatacaccttattgccctatttttacacacaaatgcatgaaattcatgctaatggtggcactgttatccgaccccttttgcatgagttctttgatgaaaaaccaacctgggatatattcaagcagttcttatggggtccagcatttatggttaccccagtactggaaccttatgttcaaactgtaaatgcctacgtccccaatgctcggtggtttgactaccatacaggcaaagatattggcgtcagaggacaatttcaaacatttaatgcttcttatgacacaataaacctacatgtccgtggtggtcacatcctaccatgtcaagagccagctcaaaacacattttacagtcgacaaaaacacatgaagctcattgttgctgcagatgataatcagatggcacagggttctctgttttgggatgatggagagagtatagacacctatgaaagagacctatatttatctgtacaatttaatttaaaccagaccaccttaacaagcactatattgaagagaggttacataaataaaagtgaaacgaggcttggatcccttcatgtatgggggaaaggaactactcctgtcaatgcagttactctaacgtataacggaaataaaaattcgcttccttttaatgaagacactaccaacatgatattacgtattgatctgaccacacacaatgttactctagaagaaccaatagaaatcaactggtcatgaagatcaccatcaattttagttgtcaatgggaaaaaacaccaggatttaagtttcacagcacttacaattttccctcttcacttggttcttgtactctacaaaatatagctttcataacatcgaaaagttattttgtagcgtacatcaatgataatgctaattttattatagtaatgtgacttggattcaattttaaggcatatttaacaaaatttgaatagccctatttatccttgttaagtatcagctacaattgtaaactagttactaaacatgtatgtaaatagctaagatataatttaaacgtgatttttaaattaaataaaatttttatgtaattatatatactatatttttctcaatgtttagcagatttaagatatgtaacaacaattatttgaagatttaattacttcttagtatgtgcatttaattagaaaaagagaataaaaaatgtaagtgtaaaaaaaaaaaatcatttttaaacatccctccaaaattaaaaacaaaaatcttactgtgtaaatctcaaaaaaacttcg

SEQ ID NO: 74288 - DNA, 6015 bp, Homo sapiens
tattttggcagccttatccaagtctggtacaacatagcaaagagaacaggctatgaaataagatggcaagaaagaaatttagtggattggaaatctctctgattgtcctttttgtcatagttactataatagctattgccttaattgttgttttagcaactaagacacctgctgttgatgaaattagtgattctacttcaactccagctactactcgtgtgactacaaatccttctgattcaggaaaatgtccaaatgtgttaaatgatcctgtcaatgtgagaataaactgcattccagaacaattcccaacagagggaatttgtgcacagagaggctgctgctggaggccgtggaatgactctcttattccttggtgcttcttcgttgataatcatggttataacgttcaagacatgacaacaacaagtattggagttgaagccaaattaaacaggataccttcacctacactatttggaaatgacatcaacagtgttctcttcacaactcaaaatcagacacccaatcgtttccggttcaagattactgatccaaataatagaagatatgaagttcctcatcagtatgtaaaagagtttactggacccacagtttctgatacgttgtatgatgtgaaggttgcccaaaacccatttagcatccaagttattaggaaaagcaacggtaaaactttgtttgacaccagcattggtcccttagtgtactctgaccagtacttacagatctcagcccgtcttccaagtgattatatttatggtattggagaacaagttcataagagatttcgtcatgatttatcctggaaaacatggccaatttttactcgagaccaacttcctggtgataataataataatttatacggccatcaaacattctttatgtgtattgaagatacatctggaaagtcattcggtgtttttttaatgaatagcaatgcaatggagatttttatccagcctactccaatagtaacatatagagttaccggtggcattctggatttttacatccttctaggagatacaccagaacaagtagttcaacagtatcaacagcttgttggactaccagcaatgccagcatattggaatcttggattccaactaagtcgctggaattataagtcactagatgtagtgaaagaagtggtaaggagaaaccgggaagctggcataccatttgatacacaggtcactgatattgactacatggaagacaagaaagactttacttatgatcaagttgcgtttaacggactccctcaatttgtgcaagatttgcatgaccatggacagaaatatgtcatcatcttggaccctgcaatttccataggtcgacgtgccaatggaacaacatatgcaacctatgagaggggaaacacacaacatgtgtggataaatgagtcagatggaagtacaccaattattggagaggtatggccaggattaacagtataccctgatttcactaatccaaactgcattgattggtgggcaaatgaatgcagtattttccatcaagaagtgcaatatgatggactttggattgacatgaatgaagtttccagctttattcaaggttcaacaaaaggatgtaatgtaaacaaattgaattatccaccgtttactcctgatattcttgacaaactcatgtattccaaaacaatttgcatggatgctgtgcagaactggggtaaacagtatgatgttcatagcctctatggatacagcatggctatagccacagagcaagctgtacaaaaagtttttcctaataagagaagcttcattcttacccgctcaacatttgctggatctggaagacatgctgctcattggttaggagacaatactgcttcatgggaacaaatggaatggtctataactggaatgctggagttcagtttgtttggaatacctttggttggagcagacatctgtggatttgtggctgaaaccacagaagaactttgcagaagatggatgcaacttggggcattttatccattttccagaaaccataattctgacggatatgaacatcaggatcctgcattttttgggcagaattcacttttggttaaatcatcaaggcagtatttaactattcgctacaccttattacccttcctctacactctgttttataaagcccatgtgtttggagaaacagtagcaagaccagttcttcatgagttttatgaggatacgaacagctggattgaggacactgagtttttgtggggccctgcattacttattactcctgttctaaaacagggagcagatactgtgagtgcctacatccctgatgctatttggtatgattatgaatctggtgcaaaaaggccatggaggaaacaacgggttgatatgtatcttccagcagacaaaataggattacatcttagaggaggttatatcatccccattcaagaaccagatgtaacaacaacagcaagccgtaagaatcctctaggacttatagtcgcattaggtgaaaacaacacagccaaaggagactttttctgggatgatggagaaactaaagatacaatacaaaatggcaactacatattatatacattttcagtttctaataacacattagatattgtgtgcacacattcatcatatcaggaaggaactaccttagcatttcagactgtaaaaatccttgggttgacagacagtgttacagaagttagagtggcggaaaataatcaaccaatgaacgctcattccaatttcacttatgatgcttctaaccaggttctcctaattgcagatctcaaacttaatcttggaagaaactttagtgttcaatggaatcaaattttctcagaaaatgaaagatttaattgttatccagatgcagatttggcaactgaacaaaagtgcacacaacgtggctgtgtatggagaacgggttcttctctatccaaagcacctgagtgttactttcccagacaagataactcttattcagtcaactcagctcgctattcatccatgggtataacagctgacctccaactaaatactgcaaatgccagaataaagttaccttctgaccccatctcaactcttcgtgtggaggtgaaatatcacaaaaatgatatgttgcagtttaagatttatgatccccaaaagaagagatatgaagtaccagtaccgttaaacattccaaccaccccaataagtacttatgaagacagactttatgatgtggaaatcaaggaaaatccttttggcatccagattcgacggagaagcagtggaagagtcatttgggattcttggctgcctggatttgcttttaatgaccagttcattcaaatatcgactcgcctgccatcagaatatatatatggttttggggaagtggaacatacagcatttaagcgagatctgaactggaatacttggggaatgttcacaagagaccaaccccctggttacaaacttaattcctatggatttcatccctattacatggctctggaagaggagggcaatgctcatggtgttttcttactcaacagcaatgcaatggatgttacattccagccaactcctgctctaacttaccgtacagttggagggatcttggatttttatatgtttttgggcccaactccacaagttgcaacaaagcaataccatgaagtaattggccatccagtcatgccagcttattgggctttgggattccaattatgtcgttatggatatgcaaatacttcagaggttcgggaattatatgacgctatggtggctgctaacatcccctatgatgttcagtacacagacattgactacatggaaaggcagctagactttacaattggtgaagcattccaggaccttcctcagtttgttgacaaaataagaggagaaggaatgagatacattattatcctggatccagcaatttcaggaaatgaaacaaagacttaccctgcatttgaaagaggacagcagaatgatgtctttgtcaaatggccaaacaccaatgacatttgttgggcaaaggtttggccagatttgcccaacataacaatagataaaactctaacggaagatgaagctgttaatgcttccagagctcatgtagctttcccagatttcttcaggacttccacagcagagtggtgggccagagaaattgtggacttttacaatgaaaagatgaagtttgatggtttgtggattgatatgaatgagccatcaagttttgtaaatggaacaactactaatcaatgcagaaatgacgaactaaattatccaccttatttcccagaactcacaaaaagaactgatggattacatttcagaacaatttgcatggaagctgagcagattcttagtgatggaacatcagttttgcattacgatgttcacaatctctatggatggtcacagatgaaacctactcatgatgcattgcaaaagacaactggaaaaagagggattgtaatttctcgttccacgtatcctactagtggacgatggggaggacactggcttggagacaactatgcacgatgggacaacatggacaaatcaatcattggtatgatggaatttagtctgtttggaatatcatatactggagcagacatctgtggttttttcaacaactcagaatatcatctctgtacccgctggatgcaacttggagcattttatccatactcaaggaatcacaacattgcaaatactagaagacaagatcccgcttcctggaatgaaacttttgctgaaatgtcaaggaatattctaaatattagatacaccttattgccctatttttacacacaaatgcatgaaattcatgctaatggtggcactgttatccgaccccttttgcatgagttctttgatgaaaaaccaacctgggatatattcaagcagttcttatggggtccagcatttatggttaccccagtactggaaccttatgttcaaactgtaaatgcctacgtccccaatgctcggtggtttgactaccatacaggcaaagatattggcgtcagaggacaatttcaaacatttaatgcttcttatgacacaataaacctacatgtccgtggtggtcacatcctaccatgtcaagagccagctcaaaacacattttacagtcgacaaaaacacatgaagctcattgttgctgcagatgataatcagatggcacagggttctctgttttgggatgatggagagagtatagacacctatgaaagagacctatatttatctgtacaatttaatttaaaccagaccaccttaacaagcactatattgaagagaggttacataaataaaagtgaaacgaggcttggatcccttcatgtatgggggaaaggaactactcctgtcaatgcagttactctaacgtataacggaaataaaaattcgcttccttttaatgaagacactaccaacatgatattacgtattgatctgaccacacacaatgttactctagaagaaccaatagaaatcaactggtcatgaagatcaccatcaattttagttgtcaatgggaaaaaacaccaggatttaagtttcacagcacttacaattttccctcttcacttggttcttgtactctacaaaatatagctttcataacatcgaaaagttattttgtagcgtacatcaatgataatgctaattttattatagtaatgtgacttggattcaattttaaggcatatttaacaaaatttgaatagccctatttatccttgttaagtatcagctacaattgtaaactagttactaaacatgtatgtaaatagctaagatataatttaaacgtgatttttaaattaaataaaatttttatgtaattatatatactatatttttctcaatgtttagcagatttaagatatgtaacaacaattatttgaagatttaattacttcttagtatgtgcatttaattagaaaaagagaataaaaaatgtaagtgtaaaaaa

SEQ ID NO: 74289 - DNA, 532 bp, Homo sapiens
tgcaaagtgtataccaaaatatatgcatgcataaaagtgtgtctcataaatatgtaagcatgcatgtatagcatgatgtacatagtatttctatgcgtgtgtgtataaatgcatgtgcatatatggatgtacacatgtataaaggtaatgcatgtatcacacagaaatatatgcattgtatatgtgaaatatataccatattcagttgatcattatttgcatattctgtgtttgcattctgtatcacctactcattaatatttctttgtcaccccaaaatcagtagttgcaacaccttcacagtcatttatggacattggcagagctttgaaaatttttgattgtctgacacacacattcccagctgaagtagaacaaggcaatattctgccttctttattcagctctcgttctgtaaataagtgtcatttttgcagcccacttaatgccacgttttttgcattttttgtgcttttttgttgatgattttgctgtttaaaatggcccccaaatgtagtgttaaattgctggt

SEQ ID NO: 74290 - DNA, 380 bp, Homo sapiens
cctgctgaatgttgtaactcagtagacaaggctttttgtcttttgacagtggcagcccaggttgaattcttggcttcggaaatgattcctttctggtttgttacttaactttcccactttttgagggtcccacccccaccccaatggctagcttccgatttcctgtcttgaatttttctttctccaaactgcccttgggaagattctaaatcttgtaaaaagaagctgcttaccatctctttgaaacaccttatgggtccatggttaagctgtaaccttagctaaaacttattaatttcacatgggaagttacctgtggcaaagttcaaaagccagaaatattgactgtcctggctagagtctgataataagagattttt

SEQ ID NO: 74291 - DNA, 370 bp, Homo sapiens
tagggactataacccagctcagaaaggtcaacttcagaggaggacagtgggaaggtttgctttgctccgtgatatagagttggtttcctttggctggggcacagcaatgggcagatgcgttgctcaaatcagacgttgaaatgaagaaggaggaggaggcagctgggtgtccagtcttcagtctggtttcccgctaatggacagagctctgcaatgactgcacaataaaccttttattctgaagccagcattggtatttactgatatgctcttactggcacaattgtttaataaaatctgcacgatctttattgcctgaaaagcaatgtgtttttccaaagaaatgtatatggccataaaatattcaaaa

SEQ ID NO: 74292 - DNA, 833 bp, Homo sapiens
tgctatttagcaactacccaggtggaagccagattatgtgctgtggaagaagatacatttgaggtttacctttatgtaactataaaagatgaaaaagtttgtgttaatgatgatcttgttgcaaagaactatgcttgttatatgtcacctacaaagaataaaaaccttgattatttagaaaaaccaagattgaatataaaatcagcaccctccttcaataaactcaatccagcacttacactctggccaatgtttttgcaaggaaaagatgttcaaggaatggaagattcacatggtgtaaattttccggcacaatctctgcaacatacatggtgcaagggtattgtcggtgacctcaggccaacagccacagcacaggacaaagctgtaaaatgtaatatggattcattgagagattcacctaaagacaaatctgaaaagaaacaccattgcatctctttaaaagatacaaataagcgtgttgaatcctcagtgtactggccagcaaaaagaggcataaccatatatgctgatccagatgtaccagaagcaagtgctttaagtcagaagtcaaatgagaaacctcttagattgactgagaagaaagaatatgatgagaagaatagctgtgtgaaattactgcagtttttaaatcctgatcctttgagagctgacggaatctctgatctccagcagacttgagattagaagagaaactccttagatgggggacttaacctgaagacatccttttagaaacgatcgaatggattgttgcttctgagaaattgttccttgttttttggataataaacgatcttccttttggtaaa

SEQ ID NO: 74293 - DNA, 552 bp, Homo sapiens
cagagagactttactatcgtctcttgaaaaatataaaccttccttaggatgctgcccactgggagaagagggaagactcaggggaaaggattcctgctcagttccacaagttgtcgaaatttgcttaattagcaaaaactgaatttaaactccacactgtccacaaactcagcctctatgttctcagtgacccttttgtattcactgctggttcctctaccatctccacttccttcccatcaaagtaagaggaccccaagccttggctttgagcaaggaggtcttatttatttgctccattccccaactccggctctaaaatcacagggggaaaaactccaaaaacagagcaaagaaaatttttaaggtctcttgtcaaatttctagatactggccacgcgcagtggctcacacctgtaatcccagcactttggaaggccaaggcgggcggatcacgaggtcaggaggtcgagaccatcctggctaacacggtgaaacctcatctctactaaaaatacaaaaaaattagctgggcgtaagcgtagatggacg

SEQ ID NO: 74294 - DNA, 1535 bp, Homo sapiens
  misc_feature (1042)..(1043): n is a, c, g, or t
tgatcttggctcactgcagcctctgcctcccgggttcaagcaattctcctgcctcagcctccccagtagctgggattacaggcgcaggccaccacgcccggccagtttttgtatttttagtagagacgaggtttcaccacgttggccaggatggtcttgatctcctgacctggtgatcctacccgcctcggcctcccaaagtgctaggatgacaggcgtgagccaccgtgcccggtccagttgtgtttttatgcactggcaaggaacaattcaaaaatgtaattaagaaaaccgctgggcgtggtggctcacgcctgtagtcccagcactttgagcggccgaggcgggtggatcccttgatcccaggagttcaagaccatcctgggcaatgtggtgaaaccccctccctacaaaaaatacaaaaaattagcggcagtgatggcatgtgcctacgatcccagctactcaggaggctgacgtgggaggatcacccgagcctgggggtcaaggctgcagtgagctgtcacatcatgcatcattgcactccagcctgaaaaaggagtgaaattctgcaacatgttacaacgtgaatgaaccttgaaaacgtcattctaagtgaaataagccagatacaaaaggacaatattgcatgtttccacttatagagatacctacaagaatcaaattcatagagacggaaagtagaatagtggttaaaggggtctgggcggagggaggaaagggaagtttgttttacgggtagagtttcagtttgggatgtcgaaaaagttctggagataaataatggtgatggttacatgccaatggctacacgaatgtacttaatgccactgaattgtatatgtgaaaaatggttaaaatggtaaattttgtatctatttaataccatcccccctaaaaaaaaaattgtttttaagagtcaagatctcactctgtctcccaggctggggtgcagtggggtaactgatcagagctcactgcagctttgaactcagccagcttccctgactcaaacgatcannccgcttcagcctcccgagtagctgggactacagacggtgccatcacgcccagctcattgttgattcccgcccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaacttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcgaggaggccgtt

SEQ ID NO: 74295 - DNA, 919 bp, Homo sapiens
gggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttgaaaaaaaaatatatgtaa

SEQ ID NO: 74296 - DNA, 558 bp, Homo sapiens
catgcttgcaactcagcaggaccacgctgaacactatagggccagaatgtgtggacttgtctttgcagctttaagatatttagtacatgacacatttaacatcttaaataagttgagctcttttacacagcagtttaatttatgggggtttgttgagtgggtcttaagcagtgctagcaaagcttaatggacttgcactaactatccttcctccctttcctttgtaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttgaaaaaaaaatatatgtaa

SEQ ID NO: 74297 - DNA, 663 bp, Homo sapiens
aagcggcggcgaaggaggggaagaagagccgcgaccgagagaggccgccgagcgtccccgccctcagagagcagcctcccgagacagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccacgaagaggtcccctcgcccccaggccggttttaccccacgcttccccccgggtataggctttattccgtctccccctcgcgacgtatt

SEQ ID NO: 74298 - DNA, 427 bp, Homo sapiens
  misc_feature (385)..(385): n is a, c, g, or t
aagcggcggcgaaggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggagngcccttcgtcctgggaaaccggtgaggccggaaaggcggtcc

SEQ ID NO: 74299 - DNA, 1092 bp, Homo sapiens
aagcggcggcgaaggaggggaagaagagccgcgaccgagagaggccgccgagcgtccccgccctcagagagcagcctcccgagacagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcaaaaaaaaaaaaaagatccgtc

SEQ ID NO: 74300 - DNA, 1071 bp, Homo sapiens
aagcggcggcgaaggaggggaagaagagccgcgaccgagagaggccgccgagcgtccccgccctcagagagcagcctcccgagacagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttca

SEQ ID NO: 74301 - DNA, 1121 bp, Homo sapiens
aagcggcggcgaaggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttca

SEQ ID NO: 74302 - DNA, 1372 bp, Homo sapiens
aagcggcggcgaaggaggggaagaagagccgcgaccgagagaggccgccgagcgtccccgccctcagagagcagcctcccgagacagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagcaaacatgataaaaatacaataagatgatattgaaaccttaaaactaggcatatgtaaatattaaaccataagatggcaggtgaagtcctgtaaacactaaactgtggggggggcccgtaacccacttagccctttccgggagtctttttcccccctataggggaccggtgttttaaagaggttttctgggaaaacccgggggttatccaagttaagacctttacatgcataat

SEQ ID NO: 74303 - DNA, 1922 bp, Homo sapiens
cgcacctcggccccgctcccgaggccctacgggcgtggcctctgtcccgggtcccgccccccagcactccggaacagcgcgctcgcagcgggaggtcgcgaagcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccc

SEQ ID NO: 74304 - DNA, 859 bp, Homo sapiens
  misc_feature (680)..(680): n is a, c, g, or t
cgcacctcggccccgctcccgaggccctacgggcgtggcctctgtcccgggtcccgccccccagcactccggaacagcgcgctcgcagcgggaggtcgcgaagcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaacgtgagccccctcccaggcccctgggacacacgggtggagggaggctccgtgagcgggcaggctctggcctcggctcccagccctgatctctctggagacgtcacaggccttggtcctactgggtaggccctggacagaacaggccctgaggtgcagcccgcaggtgggcaggatgcgcctgggcctggggcctcngaccgctccccgctgtcctcctagtctctctacctggggcccatcttgaagtttggctccaaggagcagaagcaggcgtgggtcacgcctttcaccagtggtgacaaaattggctgctttgccctcagcgaaccaggtacctgccctgtcccctcacctgtccttagggtgacaggccc

SEQ ID NO: 74305 - DNA, 1059 bp, Homo sapiens
aataacttgatagagagaaaagaattttgaaatacattccaaagtatttaagccccccaaattaaaatgaattaagacatatgcaaatagatcatgttcccaatagtttctcctgcacacacacacacacacacacacacacacgcacacactagcagcaactagtaaagccttttgcaacttgcggtgtttcccaatcatctaaatataagaagctatgagcagctccaggctgccttatctctctcacagatatctgcctcctcttggtcctgggattaaatcttctctagatcactatctcacccttcagctattcagttccccattgacaatgtaaatgtcactttgaaataactgtccctgtgacttactttgaggatgcttgaaaaagtagtgcttttgcagaagttgacgttgggttatattatttcacataaaacagaatgtggtcagtgggcaaattctgcttcttaagggtgttctagttccttttaagaaagattttatgccaagagaaaataaaaagtaactgaccttaccttgggccacccctccttttttcatgattgtaacatccatattatgtcaggaggctaacaggtcataggtagtggtgttttttttaactaaaaattagtgtcctccactgttgtacattttggccaaatgtttgttccacactggtgtggagtggagatttctgattctcagaaggccttgcctaactgttcaccatcttctatcagctctcacaaccctctcttaataacaaaccttggccgggcatggtggctcatgcctgtaatcccagcactttgggaggccaaggcgggtagatcacctgaggtcaggagttcgagaccagcctgaccaacatggtgaaaccccgtctctactaaaaatacaaaattagctgggtgtggtggtgcatgcctgtaatcccagctactctggaggctgaggcaggagaatcacttgaacccaggaggtggaggttgcagtgagccgagattgcacactctggcctgggcaacaagagcaaaactcgatctcagg

SEQ ID NO: 74306 - DNA, 624 bp, Homo sapiens
ttgtcatcacagattcttataatgctatcagttttaaactataaacatggaggcagcacccatgggagtaagatattgaacgtttacagcatgtgtacataagttacctcaaaggataattagatgattataatgacactttctttgagatagctaattttaaaaatctattgctcccaagtctaattatttgagtaatgataacatattagcaatcatgaaacttcagtcacagccaaccccattgaagaaaaaaaagtaaatcatagcattttctataaagacccaaaggattgcaccagaccaatccttgcattttctgctgtgtattctatgcccagcctcccatccgtgtgtactctaaactacctacacatgtatcattcatgtgatttcactctatttgttttcatttgttttataactcttcctttggtaccagggagataattttctagttcttctccatcctttgtgaacctctgaaagaaggcttttataattagacttcatagctttaacaaacatttcataacctgccagtaaaaatgtcagttctctgggccagggcataattaaatgagtaagtatcagtgtggtaattcagccacaaaataaaataat

SEQ ID NO: 74307 - DNA, 464 bp, Homo sapiens
ctttccgaggaacggtggtggggttacccccacagcttgtaacccctggaagcgcggttgaaccccttgttcgcccgcgcgccttgcgttggtacccgggaacatattagcaatcatgaaacttgagtcacagccaaccctattcaatccttgcattttctgctgtgtattctatgcccagcctcccatccgtgtgtactctaaactacctacacatgtatcattcatgtgatttcactctatttgttttcatttgttttataactcttcctttggtaccagggagataattttctagttcttctccatcctttgtgaacctctgaaagaaggcttttataattagacttcatagctttaacaaacatttcataacctgccagtaaaaatgtcagttctctgggccagggcataattaaatgagtaagtatcagtgtggtaattcagccacaaaataaaataat

SEQ ID NO: 74308 - DNA, 385 bp, Homo sapiens
cagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagt

SEQ ID NO: 74309 - DNA, 515 bp, Homo sapiens
cctgtctgtctccgtttgcaatcccagccgctttgtatggagagcttttacgcagcacctgaaaattcaatttgaacacctgtgtccccttcttttcaatctgggaggctgaaatttgacagacacatcatggcaaagttgtgcagcagcgatacaagtagatgctgaagaaaagggaggaatctgagcgcaggataaaatgctcaagaaaatcccattggtggaatgtttgtgagagaaaaaaaaggtggcagaaagactggtattatagtagtccctgcttatcttcgggggatattctccagaaaccccatcccgccgccagtggatgcctgagaccttggatagtaccgaaccagattgccatctattggaacatgtttctcttccatccacagatgtaatgccttttccatcttaactcagcactcatcatgcactgcggccataacttttgcagtctgaggcacaacagcaaaactagcacaaatttatttttcctacttgacaatttc

SEQ ID NO: 74310 - DNA, 366 bp, Homo sapiens
tggcatggttgcatgtgcctgtaatctcagctacttggaggctgaggcaggagaattgcttgaacctgggaggtggagtttgcagtgagccaagatcgcaccactgcactctagcctgggtgaccgagcaagattcattttcaaaataaataaataaataaatgagaaaaaaatatagatatagtaaagggaacaattacattctacaatattttagcagaagtaaatatggtttaattcaatggaaacagctctgctctatagaaaattcacaaatattaaaaataaacacactctacattaaacctctgagcactagaagcttacctacttattcataggctcacatactgtaagggggtaaat

SEQ ID NO: 74311 - DNA, 383 bp, Homo sapiens
agccttgtccatgacggactccttaaaccctgtatgtccccttataacactgtaaggaagccagacgggtcatactggctagtgcaagatctccgggctattaatcaaatagttcagaccacccacactgttgttcccaatccttacaccaatgtcagtagaatccctcacaaccaccagcggttcacggtggtagatttaaaagatgccttttgcgcttgccttttagcagaggacagccaggacatgtttgcctgtgagtgggaggaccctcactccggtcaaaaacagcagtaccaatggacagtcttgccccaagggtttacaaagtccccaaatctatttggtcaaattttagaacaagtcttggaaacttctccctg

SEQ ID NO: 74312 - DNA, 433 bp, Homo sapiens
gattagcaatactgccttgtacagatgtgacattactctttgaaaatcttcacaaaaccagagagcttcaagtcagaagtccagaccaaagaacttgagtctactgataaacaaaatattactcttgtaacaatcactgtttgacacagattttttggctttctatcctagtaaaacagcttcaaaaaattattatgagatttttttgaaattggtgagattctactagacaaaaccttactaaagaaataactaatttctcacagggaaaaaagatagcatcttgtcaatgctatataaatggcttaaaatcacaatgtaggctgggtgcagtggttcacacctgtaagcccagcactttgagaggccacagcgagcagatcacttgaggtcagaagttcaagactaacgtgatataaaaccccatctctac

SEQ ID NO: 74313 - DNA, 593 bp, Homo sapiens
tgagacagagtcttgctctgtcgcccaggctggagtgcagtggcgtgatctcggctcactgcaagccctacctcccggattcatgccattctcctgcctcagcctcccaagtagctaggactacaggtgcccgccaccacgcgcagctaatttttttgtattttttttagtagagatgggtttcaccgtgttagccaggatggtgtcgatctcctgacctcgtgatctgcccacctcagcctcccaaagtgctgggattacaggtgtgagccactgcgcccagccgagcatgactatttttaaagttcatggtgcttctagcccaactgggaggactacatcgagataagacattgttaaccgtctttgccaagaacgtttgaaagcaaaaccatagggttggagggttcctcttttgtaagctgtaggagtcccagggggatgtatgggagacacttagtgacttttaaattgattctgagctgtgatcactggtgttaagaaattatgtcctcttcttgaggggtgtacaaaatggggagtttaataataatcctctgaaacgtgaaatgaattacttagtgtctactgca

SEQ ID NO: 74314 - DNA, 375 bp, Homo sapiens
ctcccatatctctggttcaaccattttaattttcttcttttttctcatgattttttcccatcactgtagatgttctagtacatctacaaaaagtaataatgcaattttacccttcttatgtatattgatataatccagtaatcaatttatttgataactatttatagggtcccttgcaggttttattgattctacaggtaactaataatataaaagagaaataaacatgttttgacctaattgaggtgctaaatgtcattttcttatacaattgtcactaatttttcttgctttgatttctttttcatttattatacaaatctttctttgcatttttatcattggtatctattatttgatttgtttcttctgtgt

SEQ ID NO: 74315 - DNA, 280 bp, Homo sapiens
cccagttccaatttctgggatctttgggaattgatcctgaagtgctctgctgctctgaacttgagcacaggtatttttaaacctctgtggtgtctgactcctttcctgagttatttaagaactggggtgggatcccacgtccttctcccagaggtgactcgcccagttcagttctcttaaattgctggacttggagtaccagtccaggcaaggcagactctctgtaagcccactgccatctgaaacccatatgagggatgggggatgagccagatctgag

SEQ ID NO: 74316 - DNA, 958 bp, Homo sapiens
caatcctaggtatttaagtggacttgctgggtagacacagtttgcctaaataaaatggtacttgggttgattataacacttcagggatttcaaaacactttacaaacactgccattaatcctagaatatcatggtatggggaaataaagaagaagtaaagttaaggaattttcaaagacaaggatgtattcagaatgtactgatagaacagtaataactaatatgtatagtgttcttactaagtacctgaaatatttttgtaaaacttcttatatcttatctcatctgaaatgggacccaggttttcttccaaccaatataattctgtgccttatcagtaatatgtttacattctcattcaaatggccatatagcaggctttgcaattggcctcttaaacttggtgttttcccccattaccccttagcagtaattactgtcactagttttgcaaactcctactccccaaaccaagctactcaagtttatttcagtgatgaaggcatatgagcatagtcaaaacaaggagatcttggagtcaaattagaaatgagaaagaaacatcagtccagttaatagtcaagaatggacatttgaaccagacatcactgagccagagactggagatgcaaagatgagtcccatgtgactcctgccttccaggatctcaccatttagcagaggatccagacatacacacagctaactgcaatataaagtgatggggcaagagtacaggtgcagactcacttttaatgcttatctttcaaagttgtgtttctgacatgaagtgtgatttttcttttaagcatgaagttaaagagtgaaggggttatgtaaagtagagggatctcctgctcttgttagggtatttttaaggttttttctagatagtgtgtctttttggtatggtttcttggttagtattaatactttcccagactccttgagaaaaata

SEQ ID NO: 74317 - DNA, 335 bp, Homo sapiens
tttttgtatttttagtagagacggggtttcactgtgttagccaggatggtttcaatctcctgacctcgcgatctgcccgcctcagcctcccaaagtgccaggattacaggcgtgagccattgcacccaacccatttgccaattttttataaagcacttactgtgttccaggtgttattctagaagcttggaatacatttgtggacaaaataggcaaagacttctacacttgtgggccctttatgatgtagcctagagctgtgcagtgtacaacctgtgcagctgtacgtgatctacatggtggccctggagaagccccagctctggaatatgtct

SEQ ID NO: 74318 - DNA, 730 bp, Homo sapiens
gtgaatgacacatgatttacagtattgctagggcctgtaggctttgctggagcatgaggggttaaagaactaatgtgagtcaaggacagtatctgttgcgcacctacttgacacaaactactttactaggccatttcagatacacagacaaatgtcgtaaagtaatgattgagtccacaccttccttctgatatttatttgtaaggaattttatttgcatctgggagagttccattagtctctctttgtaacagacaaatctaaaacctactcccacagtttcttgtaaagaccagcacatctttgaattgtcttggttttttaataagatttccagcttttataccagatcaaggcaaactggatgtaaatatagcgttatccttgctgaacactgttgcagaccaacaggttcacagtttcctacatcctacccatttataactgaaacagtatgtcagttgatttttaaaagtgcaggtggttttctgatcgttcactatgatttcctttacagcaagggcatgagagcaccatttccccacttttatatctagtccgttcttgaaaatgtgtaacaaatgactatgcatatatatatatatagacatacatacacacatacacatatatataaagttatatatatacacacacataaacatatatattcacagaagttgtgttctcagaataatagtaaaataaacaatgatgcttcatgcaggca

SEQ ID NO: 74319 - DNA, 391 bp, Homo sapiens
ttaaaactgagtgggtcacttggtaaacgttttggaggaaacaagaggaattgggtgagggtaaggaagaaaaaaccacactaatcatctggaactcagaaattcttttgtttgtttgagacaggatctcactctgttgcccaggctggactacagtggcacgatctcggctcactgcagcctccacctctgcggctcaagcaattcttctgcgtcagcctccctagtagccaggattacagacatgcaccaccatgccctgctaatttagcatttttttttagtggggtttcgccatgttggccaggctggtctccaactcctgacctcaggtgatctacccatctcggcctcccaaagtgctgggattatacttgcgagccaccatgcc

SEQ ID NO: 74320 - DNA, 993 bp, Homo sapiens
atgtgctaaggtgtagtgtttggccaagtaggggcctgaggattagggagacacagatggagagaaacaaagaccttagaagctgaaggggaagctgggagggatgcccaggagagagagtcctcaggaaaaggccccagaggacctgaaggagaagaaggagaaggtggaggagaaggcaagccggaaagagcgaaagaaagaagtggtggaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74321 - DNA, 625 bp, Homo sapiens
ggacgcgtgggtcgacccacgcgtcggtgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74322 - DNA, 1995 bp, Homo sapiens
  misc_feature (70)..(70): n is a, c, g, or t
acaggggtgaaggcccagagaccagcagaacggcatcccagccacgacggccactttgctctgtctgctntccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcacccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaaaaa

SEQ ID NO: 74323 - DNA, 407 bp, Homo sapiens
tgggagcgattcgagttataattggttgtgaaggaggggtctaggtacagatgactgaggacggatgaagagaaatagaaggaccaggcgaataaaagtgaggacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74324 - DNA, 463 bp, Homo sapiens
cggaggtcgtgaatgcccggaggcgttgaatggcccggaggcgttgaatggcccggaggcgttgaatggcccgcgctgaagagagctgccgaagagggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttcctcccctccctttttgtataatttaataaagaaatggtcgcgcttctgtttttaa

SEQ ID NO: 74325 - DNA, 421 bp, Homo sapiens
agagccccccttcttcataagcctctcactccagggatggcttgtgcctgggtaggctggaaggggggttgggagaaagccaggaccagatggggagggcaggggcgctgagaaaaaatagagggactcagtgtccctcctcatccgcttcccttcatccttctcctccttccgccctccgtctctctctccatctcttctcacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaaaaa

SEQ ID NO: 74326 - DNA, 483 bp, Homo sapiens
ggcaaagtccgggctcaaaggagagcagagtcagggtgggtttgaagacctgaagcagggctgagggcgaccacgggggctctgccagagcttcctgcccttccccaatgacccatttctggctcctcagatgaggaagaagaagaagaggatgatgaagggcccgcgctgaagagagctgccgaagaggaggtttgggctgggttgctgggcctgaggggctgtcagggatgcagccgggctgggcgccctttggatttggacccagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaaaaa

SEQ ID NO: 74327 - DNA, 1361 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74328 - DNA, 1190 bp, Homo sapiens
aattaggctaggtcgaggcctggtgtgaatcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74329 - DNA, 1382 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaaaaaaaaaaacccacgcgtccg

SEQ ID NO: 74330 - DNA, 1607 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaaaaaacaaaaaaaaaaaccttccggggaccattattgccggggattgcagacacacaagacgggcaacatgcaacggtggccgatggtgggtccaatagagcgtgttaccctgtgtgacccagcgtttatgttggatacacagggggggaaaaaactgtggcggcggattaccgcaattaggtgacgccggatataacatctgggatgaggccgagtttaacccgtggttaataaccgcgtgggcaa

SEQ ID NO: 74331 - DNA, 2097 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaaaaaaaaaaaaaaaaaaaaaaaaaacaaaaaaaaaaaaaaaaaaaaaaaaaaaagggggcgcgcgcgcggcctaagaaagagtctactcctccgaggaggggcgcccagaacgtttcggtcgcgagcacctccgacggttattctggtgtgtaacaagcaggtgggcgtcccccataaaaaggggagccgcggtatatatatatataccgcagaagcgacgcagtgagcgcccggcgctggttaatcacaacgcggtcgctgagagctaggtgagagacaacacgtgtagcgtaacgttgtggaggcgatctctttgtgaggaggagagaagagagagcctcccttaatatctctcatgcgagggggggcggggagagagacaaatattatattgtgggtgggacgaacaacatctactactctctacaaagagagtagatatatataaagaaggcgtctctcatatgaggagggagcagatattactatatattaaaatactttttacgaagagggtggtgatatatatagtgtgtgtgggttatatacaaaacatattaacggcgctgtggtgatatatatgtgctgtgtgtggcggcgcgtgctgtgagaaaaaaaatgatgtgtgttgtgcgctatatacgtgtaaattaatatttgatattatttttatgtgatgataaacaatatatatttatatatacaccgacggcgggagagacactatttggtgatt

SEQ ID NO: 74332 - DNA, 1979 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaaaaaaaaaaaaaaaaaaaaaaaaaacaaaaaaaaaaaaaaaaaaaaaaaaaaaaaaaagaaaccaaaaaaaaaaaaaaaaaaaaaaaagaaaaaaaaaaaaaaaaaacaaagcaaccacaaaacacagacaaaaaacacataaccaaaaaacaacaccacaaaacccaggaccaacgacaggcggcgccgacacacacccatccacacgcgccacacccatcccaccacatgcgtaggagcccccgacgccgccgacttttccgtctacaactcaggcagccaggtgacccgtggcgtcctcctataatacagaagacgtcccacccgctgcaggtgatgacctcgcgccgcacccagtctcacaccatcatctactataagccaaagaacataacacactccctcccatttcactcctatcctctaccaagcattaattctcacacctaccctaacccaacctaatccacacagcacagagaccactaacacactaccacatcacgtcttcacctcccccacacacaaactcaacccaatccatatcccacacacttccctgccatcactcacaacaaaatagcaatacaaataaacacaaacataaattcttatatc

SEQ ID NO: 74333 - DNA, 1362 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgccccaccaggcttcagtgcctgaccaggcttcagtgcctgaccaggcttcagtgcctgacc

SEQ ID NO: 74334 - DNA, 1438 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74335 - DNA, 1139 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgcccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74336 - DNA, 1058 bp, Homo sapiens
ccacgcgtcgcggacgcggtgggcttctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgcccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74337 - DNA, 876 bp, Homo sapiens
tgggagcgattcgagttataattggttgtgaaggaggggtctaggtacagatgactgaggacggatgaagagaaatagaaggaccaggcgaataaaagtgaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74338 - DNA, 968 bp, Homo sapiens
cgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74339 - DNA, 916 bp, Homo sapiens
atgtgctaaggtgtagtgtttggccaagtaggggcctgaggattagggagacacagatggagagaaacaaagaccttagaagctgaaggggaagctgggagggatgcccaggagagagagtcctcaggaaaaggccccagaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74340 - DNA, 1533 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggtttgggctgggttgctgggcctgaggggctgtcagggatgcagccgggctgggcgccctttggatttggacccagatccctgtgtggcaggggtgggggctggaacaggaccgggacagggggaggtctcccctcccattttacagctcccccattctctccctctccacagatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74341 - DNA, 713 bp, Homo sapiens
atcccttccagtggggctctgcactgaggcagcgccgaccttgctgttgggccagcagggaggaggaggaagaagaaggggaagaagaaaatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74342 - DNA, 1208 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggcctcccctccctttttgtataatttaataaagaaatggtcgcgcttctgtttttaa

SEQ ID NO: 74343 - DNA, 1166 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttcctcccctccctttttgtataatttaataaagaaatggtcgcgcttctgtttttaa

SEQ ID NO: 74344 - DNA, 1291 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgagcccctgccaacaggctggggttgggaggcctctctgggcagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74345 - DNA, 925 bp, Homo sapiens
ggcaaagtccgggctcaaaggagagcagagtcagggtgggtttgaagacctgaagcagggctgagggcgaccacgggggctctgccagagcttcctgcccttccccaatgacccatttctggctcctcagatgaggaagaagaagaagaggatgatgaagggcccgcgctgaagagagctgccgaagaggaggtttgggctgggttgctgggcctgaggggctgtcagggatgcagccgggctgggcgccctttggatttggacccagatccctgtgtggcaggggtgggggctggaacaggaccgggacagggggaggtctcccctcccattttacagctcccccattctctccctctccacagatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74346 - DNA, 658 bp, Homo sapiens
cggaggtcgtgaatgcccggaggcgttgaatggcccggaggcgttgaatggcccggaggcgttgaatggcccgcgctgaagagagctgccgaagagggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74347 - DNA, 1068 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgagacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74348 - DNA, 1167 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggagatgaagcgcatcccaaacggtagaagacagtttggcctggaggtgggggtgggggcagccaagtccagccactcttcacctggctccctgctctgggccctgcaccagagctgccaccctcttctttctccccagccttctcatttccgccttcccttcctttttgtataatttaataaagaaatggttgcgcttttgttttataaactaaatataaatttcgagtgggtctcgtaccaatttgtcctaaactgagtgtattacactttactggctcgcgtttaacacgtccgcctgcttaaaccttggtgttctccatctatattctttgttcttaattctctttttccctgtttggtcattgtct

SEQ ID NO: 74349 - DNA, 1022 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggaggaggaggagaacggggctgaggaggaagaagaagaaatctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74350 - DNA, 586 bp, Homo sapiens
tcttgcagaagtgacctgaagaagacgacaagcctgctcagtcacacctggaagctgactggtccacgcatggccgaagcacgaggaagctcatcgttagattcatttttcttaaattttggacttatacagtaagggccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74351 - DNA, 1188 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggacctgaaggagaagaaggagaaggtggaggagaaggcaagccggaaagagcgaaagaaagaagtggtggagtgtgggaagaaagttagatttacgccgatgaatatgatagtgaaatggattttggcgtaggtttggtctagggtgtagcctgagaataggggaaatcagtgaatgaagcctcctatgatggcaaatacagctcctattgataggacatagtggaagtgagctacaacgtattacgtgtcgtgtagtacgatgtctagtgatgagtttgctaatacaatgccagtcaggccacctacggtgaaaagaaagatgaatcctagggctcagagcactgcagcagatcatttcatattgcttccgtggagtgtggcgagtcagctaaatactttgacgccggtggggatagcgatgattatggtagcggaggtgaaatatgctcgtgtgtctacgtctattcctactgtaaatatatggtgtgctcacacgataaaacctaggaagccaattgatatcatagctcagtacatacctatttatcccaatggttctctttttcccggagtagtaagttacaatatgggagatattc

SEQ ID NO: 74352 - DNA, 436 bp, Homo sapiens
gtctgtattgcattgtcgtgactggtgaaaaaccttagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74353 - DNA, 445 bp, Homo sapiens
cagcacagaggagggagccaggtgaagagtggctggacttggctgagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74354 - DNA, 718 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaa

SEQ ID NO: 74355 - DNA, 836 bp, Homo sapiens
cccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaagacctgaaggtggaatttgaggcggatcttttttttttttttttttttttttgagacagagtctcgctctgtcgcccaggctggagtgcagtggcgtgagctcgactcactgcaagctccgccttccgggttcacgccattctcctgcctcagcctcccaagtagctgggactacaggcgcccgccaccacacccggctaattttttgtatttttagtagagatggggtttcaccgtgttagccaggatg

SEQ ID NO: 74356 - DNA, 995 bp, Homo sapiens
ggtcgattagaggtccccagcgcatagctcatgtactcactatctctccttagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaaaaaaaaaaaaaaaaaaaaaaaaaacaaaaaaaaaaaaaaaaaaaaaaaaaaaagggggcgcgcgcgcggcctaagaaagagtctactcctccgaggaggggcgcccagaacgtttcggtcgcgagcacctccgacggttattctggtgtgtaacaagcaggtgggcgtcccccataaaaaggggagccgcggtatatatatatataccgcagaagcgacgcagtgagcgcccggcgctggttaatcacaacgcggtcgctgagagctaggtgagagacaacacgtgtagcgtaacgttgtggaggcgatctctttgtgaggaggagagaagagagagcctcccttaatatctctcatgcgagggggggcggggagagagacaaatattatattgtgggtgggacgaacaacatctactactctctacaaagagagtagatatatataaagaaggcgtctctcatatgaggagggagcagatattactatatattaaaatactttttacgaagagggtggtgatatatatagtgtgtgtgggttatatacaaaacatattaacggcgctgtggtgatatatatgtgctgtgtgtggcggcgcgtgctgtgagaaaaaaaatgatgtgtgttgtgcgctatatacgtgtaaattaatatttgatattatttttatgtgatgataaacaatatatatttatatatacaccgacggcgggagagacactatttggtgatt

SEQ ID NO: 74357 - DNA, 602 bp, Homo sapiens
cagagaagaaacagaaacccaagttcttcctgcaccctgtttctccctcgggaaacacccaggctccttctctacccctgcctctcggctcacgccccctccccttggcctctcttttgctcacctagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacaggtatgcaccccaaacttgagcaacaggacctccgaatccagcactcaaccccacacccgtgccggtcctctgtcccctgccctgaggtgtcactccctctgaagccagtgacccagtctccctgccctcgcttgcaccgttcctgcccttgctctgcaatcagcgaccctcacgccagcatcccttctctccagaagtggatgcggccagtccaacagaggggtcgggcgtgaggggacggttggtggtcaagagaactcttggggcgggctttctcatcctcaacgggtggctgcctgcatcctcccgggcttcctacccctgga

SEQ ID NO: 74358 - DNA, 716 bp, Homo sapiens
tagtcttttttctttttctcatatttagaaaataaccgtttggaaaaaatacttactctagtttagtatttttcatgctgtgcctccagctttatgttatggtttaatagtatccctttggcttggggttgggaagatttagaaataagagtatattagatatgtaataagcttgaaaagacatcttgtggaaatagatccttgggaaaacacttagatggaaacaacatttagaactctgtgaaatggaatttactgaaaacttagaggtgctactgttttcctaagcactctacttgtgacagttaagtgtagattgagcccagggctcagcacattagagacttaaggaagaaatcatttcttcaatttttcctctgcagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaatatgcctcattcgtatagtttt

SEQ ID NO: 74359 - DNA, 704 bp, Homo sapiens
aagtggcagatccagaattcatacatgtaagtgcttgctcattccactatgccactctcctatttagagtgctggaactgggacagtttctgatcttctgaaatatttgtggtttggagttttaagtggaaaatttttaagagagtgaagcaaagcttcttctaggaactttgtgaatcttaaagctggtaaattagacatttaagtatcttctaggagtacagaaataaatgaggcatggtgtcattctttagaaattgtctagctgatgccaatcactagtaccctgaagaagtgtctaatgctcccccttcgtagaaaattagaatttagtccggctctttatttttcattcctagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74360 - DNA, 396 bp, Homo sapiens
tcccctggccccatccccctaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggctcgggaggctaaggtaggagaatcgcttcaacctgggaggcggaggttgtggtgagccgagatcgtgccattgcactccagcctgggcaacaagagcgaaacttcgtctcacacacacaa

SEQ ID NO: 74361 - DNA, 574 bp, Homo sapiens
ctccgccccatacctcttcaaatgtttaaaaaaaaaaaaaaaaaagtactgtacattccttttttcatattaaaatttagaaatccattttgtattttgcatttagagcacatcttaatttagactggctacatttccagtgctcaacaggccacatgtaggtagtggatactgtattggacagtgcagctctagaatgatagattcttggcctcctgagatgttgataaatgctgaatccagaaagcctttttaccatgcatgtaagacataggaggaaataaaatgtaaatacagctgttatggagaatagtacttaaatccattgagtcacttaaatgtggaattaatgttggtcttttcctcacacctgtaatcccagcgctttgggaggccgaggcatttccactaaaactacaaaaaaattagccgggcatggtggcgggcgcctgtagtcccagctactcgggaggctgaggcaggagaatggtgggaacccaggaggcggagcttgcagtgagccgagatcgcgccactgcactccagcctgggcgacagagcaagactccgtcgc

SEQ ID NO: 74362 - DNA, 444 bp, Homo sapiens
ctccgccccatacctcttcaaatgtttaaaaaaaaaaaaaaaaaagtactgtacattccttttttcatattaaaatttagaaatccattttgtattttgcatttagagcacatcttaatttagactggctacatttccagtgctcaacaggccacatgtaggtagtggatactgtattggacagtgcagctctagaatgatagattcttggcctcctgagatgttgataaatgctgaatccagaaagcctttttaccatgcatagagagagacctggagtagagattctgtcaaagaactttttctttcttgagaagcatctgaaatggaatctgttgtctcttcgaaatatgtactgctgtaacagtgaaacaaccctcagagtatgccttcgtgtgggctgctcgttgtggttttgaccgcggtgcgcgtggggatcctcag

SEQ ID NO: 74363 - DNA, 397 bp, Homo sapiens
tagtcttttttctttttctcatatttagaaaataaccgtttggaaaaaatacttactctagtttagtatttttcatgctgtgcctccagctttatgttatggtttaatagtatccctttggcttggggttgggaagatttagaaataagagtatattagatatgtaataagcttgaaaagacatcttgtggaaatagatccttgggaaaacacttagatggaaacaacatttagaactctgtgaaatggaatttactatacaggaggagagagatgatgaacctcatatgcattatgcctcataatgttgaaatgatgtttgaggacacgctcagtcccctacatgcatgtattatcttgtgaaataatagctgcgtcaggtaatgcagcgtttgga

SEQ ID NO: 74364 - DNA, 316 bp, Homo sapiens
cctagttttagaagtttcaatagccctagttttagaagtttcgatagcagttaagtgtagattgagcccagggctcagcacattagagacttaaggaagaaatcatttcttcaatttttcctctgcagtggtggtgaccgcggtggcttcaaaaattttggtggtaagtgctgagtatcccaaaatgtttcagtggaaatgctattgaaacttctaaaactaggcctagtttagaagtttcaatagcatgactttaaataacacttatactgagagcacttacacttttatctgtcgtgacatttttctcaaactt

SEQ ID NO: 74365 - DNA, 2209 bp, Homo sapiens
aaaaaaaaaaaaaaaaaaaaaattataaaaaaaatttaaagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74366 - DNA, 2200 bp, Homo sapiens
  misc_feature (8)..(8): n is a, c, g, or t
ttaaaagnggcggacggtccggaattcccgggtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74367 - DNA, 2547 bp, Homo sapiens
ctttggaaatatttttgaggtgctgacagccaaagcagtccaatacagaggaatggtgtatatcttggggtggtaaggatgttcaagtagatgtaatcctggggatgtcatagtgcatgtctttcccctttttggacctgattagttttaacagatgtctttttgtatataataatattgcttaaggtcttgagtctgtttaaagaatggattttcactgtttacatttgttcactgggttcttgtgaccctagcacacatgtagaatagtagtttgcaaatacgtagttattgtaaaaagtaaatactatttgtacaaatttcttgtttcatagtatttaacttgagttagtttttctttctgcagttctttacattttcttaccacatttcttctgtatgagctaaagtcagcctttgaaggaaccataattttaaataagatttaaaattctttttatgtgttctagattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74368 - DNA, 2119 bp, Homo sapiens
gggtcgtctagaggatccctagctggtcgcaagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74369 - DNA, 4080 bp, Homo sapiens
aaaaaaaaaaaaaaaaaaaaaattataaaaaaaatttaaagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaaggtaagtatgtagataaagatgcgtacatttcttcttcttcctctttttttttttttttaaggtgttacttggctggatcaattccagcatctaatttagttaagagactttaaaaagggattatatattggagaaaaaggcagaaattaaaagtgtattttcagtcttaatatctcacataaatgaccttagaattggctatgttagtagttagtttatgtggtacatgttaaacaccagtagagaaacaactatggttgtgattaaatcacttgactttcctgccagagctagaatcttaactcctttaaaagacgactctgggaaatccagtgtttgtatgtaaaaataaaaggtaagttaattctagattgaggggcagaggctatttcttaatctccaatctccttgggaagggaaagtattaggaggcagtaatggagtagaaaggtggggatggcaaataagagaaagatttaatgtaacaaaactgttttgtccctcttcttaagtaaataattattggaataattagtgtaacatcacatagtaatgtgtattttgtcttgactaagttgtgtaaaggaatgtctttttaattcagcttttcttttctccatgctagtgttatcaggttttggtatttatttacttacagcatatgttatgaagctggtttgaaaattggttttagatatatctgcaagtttactactttgactgtaaaaaaaaaaaaatgaaaaagtagttgacatctgtcctcagaagaagtttgcaggttgcatatttgtgtgtaaatacacaggctaaaaggtaatttatgttccttgggaattgaaatggtcagtggcccgttacagaaacttatcagtcatatatcagcaccagttcattcttttgcaccttagggaccatctgtcccctgaggtgacctgagaaacaaccagttgcccacagactgttatttcttcaagtgagccaggatttgatttcactgccttatattctatttttagtgtacagtgctttgattttttggaaaaactaaattttaaacatatttgaaaaatgttataagacttggacattaagtctgttgatagccaaagtcagtttaccaaagtaaaacaaataaattctatgcttcttcattgtcaaagagcagtctgccatcatgtggatataaatggactatgtaaagtgacatggtgcttactctctacctaataatagcctccctcctgttccaaacaagataaccaacaggtatatttaatttaccagttaatatgttttggataattggctgccttgaaatgctatatgttttatagtacatcatagctttagttttcttcataaggaaattacagttacatcctggctaacatggtgaaactccatctctactaaaaatacaaaaaattagccgggcgtggtggcgggcacttgtagtcccagctactcgggaggctgaggcaggagaatggcgtgaacccaggaggcggaggttgcagtgagccgagatcgtgccactgtactctggcctgggagacagagcgagactccatctcaaaaaaaaaaaaaaaaaaaaaaaaagagagagagagacctggagtagagattctgtcaaagaactttttctttcttgagaagcatctgaaatggaatctgttgtctcttcgaaatatgtactgctgtaacagtgaaacaaccctcagagtatgccttcgtgtgggctgctcgttgtggttttgaacttgggggaactgtctgtgtttgggtcaagaatatgcaactggctgggcacattggctcacgcctgtaatcccagcaatttgggaggctgaggcaggtggatcacctgaggtcagggcttcaagaccagactggccaacatggtgaaaccccgtctctactgaaaatacaaaaattagctgggcatggtggcaggtgcctgtaatcccagctactcgggaggctgacgtgagagaatcgcttgaacccgggagttggaggttgcagtgagccgagattgcaccattgcactccagcttgggcaacaagagtgaaactcttgtctcagaaaaaaaaaaaaaagtatgcaactagctgggggctgtgacgcgtacctgtagtcccagctacttaggaggctgaggtgggaggatcactgatgctcaggagttcgtgaccagactaggcaaaatagcaagacaccatctcaaaaaacaaacaaaaaaaccagctagttttcttatgcagggggtactctgccaataaagttgagtatgcttatattgtgtttctgttaaatatctctgctacttcaggaattctttatgtgtaaatgttttctgctttttctgggaattaaagcaaatttgttgtgtcaacatcttgactcagatgttcaagtacctttgtgtcttgatttgccttagcatgtagaaaagggacttgtaacattaatgcagatttgaaagaaagattgttaacctcaggcacatcttctgttaatatctaatagtactacttgaaggttattttctgtatttaataaattccttaaaaaggataattttctaataaggagagagaaaatgattgaaacgtttgaacttgaaagaaggctttgcataaaattacagatcatctagatcaatgcctaaaccaaatgtctagacattttagacttaaatgtgcatatgaattacttgggggatcttattaaatgcaggttcttattcagtaggtctagggtggggcctgagatcctgcttttctcagaaccttccaggctatgcttacgcttatattccatcatgttttgattagtaaggggacagacccttattttgttaaggagattgaagcttatggagaaccactgacatgtccagattttcaagattgattagttatagttaagactgtaccctgagtttcttgaagactagttctttttccagtgtactatggtatttccaaatttatggccatgtgttgaaatcttcagctgctttattttcaaaggaaatgcacagtaaagatgacgttcaaggccgggcgcagtgactcatgcctgtaatcccagtgctttgggaggccgagacgggcggatcatgaaggtcaggagattgagaccatcctggctaacacggtgaaaccccgtctctactaaaaatacaaaaacaaaaattagccgggcatggtggcgggcgcctgtagtcccagctactcgggaggctgaggcaggagaatggtgggaacccaggaggcggagcttgcagtgagccgagatcgcgccactgcactccagcctgggcgacagagcaagactccgtcgc

SEQ ID NO: 74370 - DNA, 2008 bp, Homo sapiens
aaaaaaaaaaaaaaaaaaaaaattataaaaaaaatttaaagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74371 - DNA, 1972 bp, Homo sapiens
  misc_feature (1910)..(1910): n is a, c, g, or t
  misc_feature (1921)..(1921): n is a, c, g, or t
  misc_feature (1949)..(1949): n is a, c, g, or t
aaaaaaaaaaaaaaaaaaaaaattataaaaaaaatttaaagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagtttccctctttaaggaagaaaggaaagtgtttctcctggatactangatatgctgangttgggacacggagctaacggacacganatgttcacgggtaccggagctcg

SEQ ID NO: 74372 - DNA, 1944 bp, Homo sapiens
tctgaggatcccgtggcttctcgtattatcgcaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74373 - DNA, 3061 bp, Homo sapiens
aaaaaaaaaaaaaaaaaaaaaattataaaaaaaatttaaagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaaggtaagtatgtagataaagatgcgtacatttcttcttcttcctctttttttttttttttaaggtgttacttggctggatcaattccagcatctaatttagttaagagactttaaaaagggattatatattggagaaaaaggcagaaattaaaagtgtattttcagtcttaatatctcacataaatgaccttagaattggctatgttagtagttagtttatgtggtacatgttaaacaccagtagagaaacaactatggttgtgattaaatcacttgactttcctgccagagctagaatcttaactcctttaaaagacgactctgggaaatccagtgtttgtatgtaaaaataaaaggtaagttaattctagattgaggggcagaggctatttcttaatctccaatctccttgggaagggaaagtattaggaggcagtaatggagtagaaaggtggggatggcaaataagagaaagatttaatgtaacaaaactgttttgtccctcttcttaagtaaataattattggaataattagtgtaacatcacatagtaatgtgtattttgtcttgactaagttgtgtaaaggaatgtctttttaattcagcttttcttttctccatgctagtgttatcaggttttggtatttatttacttacagcatatgttatgaagctggtttgaaaattggttttagatatatctgcaagtttactactttgactgtaaaaaaaaaaaaatgaaaaagtagttgacatctgtcctcagaagaagtttgcaggttgcatatttgtgtgtaaatacacaggctaaaaggtaatttatgttccttgggaattgaaatggtcagtggcccgttacagaaacttatcagtcatatatcagcaccagttcattcttttgcaccttagggaccatctgtcccctgaggtgacctgagaaacaaccagttgcccacagactgttatttcttcaagtgagccaggatttgatttcactgccttatattctatttttagtgtacagtgctttgattttttggaaaaactaaattttaaacatatttgaaaaatgttataagacttggacattaagtctgttgatagccaaagtcagtttaccaaagtaaaacaaataaattctatgcttcttcattgtcaaagagcagtctgccatcatgtggatataaatggactatgtaaagtgacatggtgcttactctctacctaataatagcctccctcctgttccaaacaagataaccaacaggtatatttaatttaccagttaatatgttttggataattggctgccttgaaatgctatatgttttatagtacatcatagctttagttttcttcataaggaaattacagttacatcctaatcgattattaaactatcactgtgtctaagaatggtggaagaagatagggaataggtagggaagtcattataaatatattttcactggccaggcgtggtgacccatgcctgtaatcccagcactttgggaggccgaggcgggcggatcacgaggtcaggagatggagaccatcctggccaacacagtgaaaccccgtctctactaaaaatacaaaaagttggccggacgtggtggcaggcgcctgtagtcgtagtccgaactactcaggaggctgaggcaggagaatgttgtgaacccgggaggcggagcatgcagtgagccgagatcgtgccactgcactccagcctgggcgacagagcaagactccgtctcaaaaaaaaaaacattaaaaaaaaatgtattttcatttgtgactcatcttgtaactagaggatcgaaaggactttgaatgatcctcctgacaaaggagggaagcagtaccttaatcaaccctggggtccaattaagtacttttataaaccccttgcaacatacttcatataatttgtggcctagatactgacttataaactaaattttttattttcctttaataccccttaatacaaaatcatatgcagaagtccaatatctagttggtccaaatgatgtgctgatctggtttcagtgggggaaaggtcgggtgaggaagggatctgcaatcttgccttatactctgttatttgttgagatgttcatgaaaggccttttttagaaatccgtatggatgccgattactctttatattgagttggcaagctgtgtgaaaggccagatagtaaatgttctgggtttggtgaaccatatggtttctattgtaactattcatctctgcccttggagcaccagagcagccgtaattaatatgtaaatgaataaacagagttgtgttccagtaaagcttcatt

SEQ ID NO: 74374 - DNA, 2718 bp, Homo sapiens
ctttggaaatatttttgaggtgctgacagccaaagcagtccaatacagaggaatggtgtatatcttggggtggtaaggatgttcaagtagatgtaatcctggggatgtcatagtgcatgtctttcccctttttggacctgattagttttaacagatgtctttttgtatataataatattgcttaaggtcttgagtctgtttaaagaatggattttcactgtttacatttgttcactgggttcttgtgaccctagcacacatgtagaatagtagtttgcaaatacgtagttattgtaaaaagtaaatactatttgtacaaatttcttgtttcatagtatttaacttgagttagtttttctttctgcagttctttacattttcttaccacatttcttctgtatgagctaaagtcagcctttgaaggaaccataattttaaataagatttaaaattctttttatgtgttctagattctggaagttacggtcagtctgggggtgagcagcaaagttattctacctatggaaatccaggcagccaaggctatggacaagcatcacaagtaggttgaaatataaattgtattcttcataagtagttatttttatcttaagtaggtgatgaaacttgagtatttacctaaatttcagagctattctggctatgggcaaacgactgattcctcttatggacagaactacagcggttactccagttatggacaaagtcagtcaggttggactagtttgttaaatttgttgtttcagagattgaaaaatcagagccttcactaaatgatatactcatctaatctttaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74375 - DNA, 2371 bp, Homo sapiens
  misc_feature (8)..(8): n is a, c, g, or t
ttaaaagnggcggacggtccggaattcccgggtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaagtaggttgaaatataaattgtattcttcataagtagttatttttatcttaagtaggtgatgaaacttgagtatttacctaaatttcagagctattctggctatgggcaaacgactgattcctcttatggacagaactacagcggttactccagttatggacaaagtcagtcaggttggactagtttgttaaatttgttgtttcagagattgaaaaatcagagccttcactaaatgatatactcatctaatctttaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74376 - DNA, 1533 bp, Homo sapiens
aaaaaaaaaaaaaaaaaaaaaattataaaaaaaatttaaagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggggaggcggcccaggcttgacagaggctctgtccctgggacatcagcatttgctgagggaagggaaggcagacactgcggaactgctcatgggcatttcagtgtctgtctggagcttcatgtgtcacctgtgctcacatttcattggccc

SEQ ID NO: 74377 - DNA, 1492 bp, Homo sapiens
aaaaaaaaaaaaaaaaaaaaaattataaaaaaaatttaaagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaaggtaagtatgtagataaagatgcgtacatttcttcttcttcctctttttttttttttttaaggtgttacttggctggatcaattccagcatctaatttagttaagagactttaaaaagggattatatattggagaaaaaggcagaaattaaaagtgtattttcagtcttaatatctcacataaatgaccttagaattggctatgttagtagttagtttatgtggtacatgttaaacaccagtagagaaacaactatggttgtgattaaatcacttgactttcctgccagagctagaatcttaactcctttaaaagacgactctgggaaatccagtgtttgtatgtaaaaataaaaggtaagttaattctagattgaggggcagaggctatttcttaatctccaatctccttgggaagggaaagtattaggaggcagtaatggagtagaaaggtggggatggcaaataagagaaagatttaatgtaacaaaactgttttgtccctcttcttaagtaaataattattggaataattagtgtaacatcacatagtaatgtgtattttgtcttgactaagttgtgtaaaggaatgtctttttaattcagcttttcttttctccatgctagtgttatcaggttttggtatttatttacttacagcatatgttatgaagctggtttgaaaattggttttagatatatctgcaagtttactactttgactgtaaaaaaaaaattgaaatacacaggcttaaaggtaattt

SEQ ID NO: 74378 - DNA, 2149 bp, Homo sapiens
tgagccacgatcgcgccattgcactccagcagcctgggcaacacagagtgaacctctgtttccaaaaaaaaaaaaaaagttcaaggagatagtaaaaagccatagtaattttttgctttactgcagttttcaaagatacattttttttcataatgtggcacctcttcaatgttggcagaatcgtctttcgcagggaattccaggagactgcagataactaattaccatgagaaggtagtcataaatatggttaatgtctctaactggtcaggactcttaacatcagtttcagccaacttgctacagcaaatgtaatcttcctatgaagtctcttaagttctccatttctatttagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74379 - DNA, 1862 bp, Homo sapiens
tagtcttttttctttttctcatatttagaaaataaccgtttggaaaaaatacttactctagtttagtatttttcatgctgtgcctccagctttatgttatggtttaatagtatccctttggcttggggttgggaagatttagaaataagagtatattagatatgtaataagcttgaaaagacatcttgtggaaatagatccttgggaaaacacttagatggaaacaacatttagaactctgtgaaatggaatttactgaaaacttagaggtgctactgttttcctaagcactctacttgtgacagttaagtgtagattgagcccagggctcagcacattagagacttaaggaagaaatcatttcttcaatttttcctctgcagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74380 - DNA, 1792 bp, Homo sapiens
cgttagaggatccagtctggtccccagtatggtttaatagtatccctttggcttggggttgggaagatttagaaataagagtatattagatatgtaataagcttgaaaagacatcttgtggaaatagatccttgggaaaacacttagatggaaacaacatttagaactctgtgaaatggaatttactgaaaacttagaggtgctactgttttcctaagcactctacttgtgacagttaagtgtagattgagcccagggctcagcacattagagacttaaggaagaaatcatttcttcaatttttcctctgcagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74381 - DNA, 973 bp, Homo sapiens
  misc_feature (10)..(10): n is a, c, g, or t
gagagtggantggagtgggcgcgagccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaacttttgtacatacta

SEQ ID NO: 74382 - DNA, 1105 bp, Homo sapiens
ctttggaaatatttttgaggtgctgacagccaaagcagtccaatacagaggaatggtgtatatcttggggtggtaaggatgttcaagtagatgtaatcctggggatgtcatagtgcatgtctttcccctttttggacctgattagttttaacagatgtctttttgtatataataatattgcttaaggtcttgagtctgtttaaagaatggattttcactgtttacatttgttcactgggttcttgtgaccctagcacacatgtagaatagtagtttgcaaatacgtagttattgtaaaaagtaaatactatttgtacaaatttcttgtttcatagtatttaacttgagttagtttttctttctgcagttctttacattttcttaccacatttcttctgtatgagctaaagtcagcctttgaaggaaccataattttaaataagatttaaaattctttttatgtgttctagattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccacc

SEQ ID NO: 74383 - DNA, 1988 bp, Homo sapiens
caacgatggtcctcagctgacactgtggggtctgtgctcactctggatggtgggcgtgagggttgagttaaattgtaggatgccgccgggcacagggctcatgcctgtaatcccagctactcgggaggctgaggcaggagaatggcgtgaacccaggaggcggaggttgcagtgagccgagatcgtgccactgtactctggcctgggagacagagcgagactccatctcaaaaaaaaaaaagagagagacctggagtagagattctgtcaaagaactttttctttcttgagaagcatctgaaatggaatctgttgtctcttcgaaatatgtactgctgtaacagtgaaacaaccctcagagtatgccttcgtgtgggctgctcgttgtggttttgaacttgggggaactgtctgtgtttgggtcaagaatatgcaactggctgggcacattggctcacgcctgtaatcccagcaatttgggaggctgaggcaggtggatcacctgaggtcagggcttcaagaccagactggccaacatggtgaaaccccgtctctactgaaaatacaaaaattagctgggcatggtggcaggtgcctgtaatcccagctactcgggaggctgacgtgagagaatcgcttgaacccgggagttggaggttgcagtgagccgagattgcaccattgcactccagcttgggcaacaagagtgaaactcttgtctcagaaaaaaaaaaaaaagtatgcaactagctgggggctgtgacgcgtacctgtagtcccagctacttaggaggctgaggtgggaggatcactgatgctcaggagttcgtgaccagactaggcaaaatagcaagacaccatctcaaaaaacaaacaaaaaaaccagctagttttcttatgcagggggtactctgccaataaagttgagtatgcttatattgtgtttctgttaaatatctctgctacttcaggaattctttatgtgtaaatgttttctgctttttctgggaattaaagcaaatttgttgtgtcaacatcttgactcagatgttcaagtacctttgtgtcttgatttgccttagcatgtagaaaagggacttgtaacattaatgcagatttgaaagaaagattgttaacctcaggcacatcttctgttaatatctaatagtactacttgaaggttattttctgtatttaataaattccttaaaaaggataattttctaataaggagagagaaaatgattgaaacgtttgaacttgaaagaaggctttgcataaaattacagatcatctagatcaatgcctaaaccaaatgtctagacattttagacttaaatgtgcatatgaattacttgggggatcttattaaatgcaggttcttattcagtaggtctagggtggggcctgagatcctgcttttctcagaaccttccaggctatgcttacgcttatattccatcatgttttgattagtaaggggacagacccttattttgttaaggagattgaagcttatggagaaccactgacatgtccagattttcaagattgattagttatagttaagactgtaccctgagtttcttgaagactagttctttttccagtgtactatggtatttccaaatttatggccatgtgttgaaatcttcagctgctttattttcaaaggaaatgcacagtaaagatgacgttcaaggccgggcgcagtgactcatgcctgtaatcccagtgctttgggaggccgagacgggcggatcatgaaggtcaggagattgagaccatcctggctaacacggtgaaaccccgtctctactaaaaatacaaaaacaaaaattagccgggcatggtggcgggcgcctgtagtcccagctactcgggaggctgaggcaggagaatggtgggaacccaggaggcggagcttgcagtgagccgagatcgcgccactgcactccagcctgggcgacagagcaagactccgtcgc

SEQ ID NO: 74384 - DNA, 1701 bp, Homo sapiens
ttgccaaagcgtagtacccaaaaaaataaaaaaaaaagaaactgaagctaagagaagtgaaacaaccctcagagtatgccttcgtgtgggctgctcgttgtggttttgaacttgggggaactgtctgtgtttgggtcaagaatatgcaactggctgggcacattggctcacgcctgtaatcccagcaatttgggaggctgaggcaggtggatcacctgaggtcagggcttcaagaccagactggccaacatggtgaaaccccgtctctactgaaaatacaaaaattagctgggcatggtggcaggtgcctgtaatcccagctactcgggaggctgacgtgagagaatcgcttgaacccgggagttggaggttgcagtgagccgagattgcaccattgcactccagcttgggcaacaagagtgaaactcttgtctcagaaaaaaaaaaaaaagtatgcaactagctgggggctgtgacgcgtacctgtagtcccagctacttaggaggctgaggtgggaggatcactgatgctcaggagttcgtgaccagactaggcaaaatagcaagacaccatctcaaaaaacaaacaaaaaaaccagctagttttcttatgcagggggtactctgccaataaagttgagtatgcttatattgtgtttctgttaaatatctctgctacttcaggaattctttatgtgtaaatgttttctgctttttctgggaattaaagcaaatttgttgtgtcaacatcttgactcagatgttcaagtacctttgtgtcttgatttgccttagcatgtagaaaagggacttgtaacattaatgcagatttgaaagaaagattgttaacctcaggcacatcttctgttaatatctaatagtactacttgaaggttattttctgtatttaataaattccttaaaaaggataattttctaataaggagagagaaaatgattgaaacgtttgaacttgaaagaaggctttgcataaaattacagatcatctagatcaatgcctaaaccaaatgtctagacattttagacttaaatgtgcatatgaattacttgggggatcttattaaatgcaggttcttattcagtaggtctagggtggggcctgagatcctgcttttctcagaaccttccaggctatgcttacgcttatattccatcatgttttgattagtaaggggacagacccttattttgttaaggagattgaagcttatggagaaccactgacatgtccagattttcaagattgattagttatagttaagactgtaccctgagtttcttgaagactagttctttttccagtgtactatggtatttccaaatttatggccatgtgttgaaatcttcagctgctttattttcaaaggaaatgcacagtaaagatgacgttcaaggccgggcgcagtgactcatgcctgtaatcccagtgctttgggaggccgagacgggcggatcatgaaggtcaggagattgagaccatcctggctaacacggtgaaaccccgtctctactaaaaatacaaaaacaaaaattagccgggcatggtggcgggcgcctgtagtcccagctactcgggaggctgaggcaggagaatggtgggaacccaggaggcggagcttgcagtgagccgagatcgcgccactgcactccagcctgggcgacagagcaagactccgtcgc

SEQ ID NO: 74385 - DNA, 817 bp, Homo sapiens
  misc_feature (8)..(8): n is a, c, g, or t
ttaaaagnggcggacggtccggaattcccgggtacagctccggccgccgcgccgcctggctttcgtattcgttgttctcggcgggctgtggggcctccgcgccgcggccgttagtcatgtcgggtaggtgacttcttcagcgagcagcggcagcgacgagaaggtcctggcggggttgggctgtcttcccgcccaccggagggccctgaggagaagcctccggccctgagggaggcttggggtgggggggcggccgctgccgccgccatgttgaactggaggcacgcacgctcccaatggctccccggctgcaaatcacggcgggagcgcctcgggcctcttgtcttttgaccctgtccttggaacccgaggagacttgccgttcccgggggagggtgtgtgtgagtcggggggcggaggccgtctacgccatcgtaggggcggggggagccgagattagagcatcagcctgagagaagcggtgcttctggttctccgctccgcctcggatctttcagcgaggcctcgggccagtcatctcgccgcctcgtacctcagttttcccatcctcgaagtggagctgggcctgcctgactcacccattcatcaggtgggggccttgacgctctgggagccctttcaaaggacgttgccttacacgaaatcgtacttatcgttattcactctgcagtaaccacctggatttgagttgggggtgtttgcatagtaatttagcttcctcttcaccctcctgccattcgtcttccccaccagtttatctcctgaaagagtttgaaagtgagccttgtctatctat

SEQ ID NO: 74386 - DNA, 838 bp, Homo sapiens
  misc_feature (8)..(8): n is a, c, g, or t
ttaaaagnggcggacggtccggaattcccgggtacagctccggccgccgcgccgcctggctttcgtattcgttgttctcggcgggctgtggggcctccgcgccgcggccgttagtcatgtcgggtaggtgacttcttcagcgagcagcggcagcgacgagaaggtcctggcggggttgggctgtcttcccgcccaccggagggccctgaggagaagcctccggccctgagggaggcttggggtgggggggcggccgctgccgccgccatgttgaactggaggcacgcacgctcccaatggctcctggctgcgctcccaacggtatccggctgcaaatcacggcgggagcgcctcgggcctcttgtcttttgaccctgtccttggaacccgaggagacttgccgttcccgggggagggtgtgtgtgagtcggggggcggaggccgtctacgccatcgtaggggcggggggagccgagattagagcatcagcctgagagaagcggtgcttctggttctccgctccgcctcggatctttcagcgaggcctcgggccagtcatctcgccgcctcgtacctcagttttcccatcctcgaagtggagctgggcctgcctgactcacccattcatcaggtgggggccttgacgctctgggagccctttcaaaggacgttgccttacacgaaatcgtacttatcgttattcactctgcagtaaccacctggatttgagttgggggtgtttgcatagtaatttagcttcctcttcaccctcctgccattcgtcttccccaccagtttatctcctgaaagagtttgaaagtgagccttgtctatctat

SEQ ID NO: 74387 - DNA, 262 bp, Homo sapiens
ttaaatccattgagtcacttaaatgtggaattaatgttggtcttttcctcacactcagaaaattgtattctggatttagtagtctgaaaacccaagcacagcatgggtttttaagctaacctttctccatttttagccaagtcctttctctctagttagtgaaattttctaagaatagagattcctgcattgtccttttacttcttggcagttttagtccataaatagatatagttaggtttttattttatttttattattt

SEQ ID NO: 74388 - DNA, 458 bp, Homo sapiens
caggactcttaacatcagtttcagccaacttgctacagcaaatgtaatcttcctatgaagtctcttaagttctccatttctatttagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaaggtaagatttactgacctctattattatttttccccctctcagaattatttgtatgaatttctgattaaaagaaccacagaggatttcacctgtttgtaaaaatttagggtaaccttgaagatatgttccctctcatggtaatcaaaactagtttatcagatttctacttctgaactt

SEQ ID NO: 74389 - DNA, 842 bp, Homo sapiens
cctgaggagactcggtgctccccacagaactccccagcgatcccagatgggagaagctgagctgcgcgggcgctgccctcactccgggggtgaaacgtggctgtgatttccacaggtgacagaaaccaggcagtgattcaactcgtatttgactttcacattctccagcaatgttcttcaatctgggaagggtagaaaattaaagaaaggtaaggagagttaaaaaatgagatcatttcaaagtagatgcagtcttgaagcccaaatgaattacgagatccagtttgaaagctgctgcagaagtgatttcagaatcgcgcggtggctccggaatggggaactgctgctgaaagaggtcggaaagggtggggactgaatttcgggtaagaggacgccagtggttctggagcacgcggccttcagccatgcctgcgttcacaagtacattatttcagactcactccaagtttacatctctaagcccatccaagccatggcagcgcgaacctctccctcccccagctcaaggcctctgggcccccaggacagaggacagaagagccagcccctcctggctcagggttgccgggaccccgtgatggctgctgtgcctctcctgaggtgccaggtgagagctgagacttctgctcccgctgcaccagctccgtttgtctccaggcgcagtgtcagtctcgttctttaagcgcttctgaggtcccatcagcacaggtctcgtcttacctggaaaggcttgttgccttgtgcctgggactttttattctgtgcttttcttctggatattaaatttcatatccacgcttgcttgtcactcagaccttatt

SEQ ID NO: 74390 - DNA, 7135 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatggaatttaagatgaagacagtaatataatattttggtacaaaaacagctgcaggaagaggtggaggggggcctgtcattatgtttcccccccaccccccaacgaaaggaaaactaagactcccaacataaacagggccttgaagggggggattacaggcacttgggcatggagtcttcggctgcaggaagcactccgcttattcttcaggaatgggaaaggcgtgacccaacgagagcatctgtctcagagctccactcagggtcacccctctccagaggccggtatggggtggcttcagacttccactgcacgacctggagcaccaagaccacacaccacaataccaaattcacccaagaagaggtctaattgtagtgttcaaggagatgatggagttgcagagagacctggtgccaaatcgaaggatacaggcagacaccaagaccaggaagacggctatagctgagatggccagtgcaatgcgcagccctatagcacctctgtgggagtcctcgatgcagctgctgtagatccagaagagcaaaagcaggaggcagtagagggccaagaggccagaggccccagctacaaagtagcacagggatggtgctgagggacgggataaggccagggaggagccattcagggtggccacaccatacaggggacatctaccactgaaggagccctgggtccgagtcatcgccgcggccgccacggccccgcacaggaaggcggcagcaaagagcgcaagctcgacgcgctgcagccaggacagcgccatggcgccctgaccaccag

SEQ ID NO: 74391 - DNA, 502 bp, Homo sapiens
  misc_feature (16)..(16): n is a, c, g, or t
gaattcaagcttctancgatgtagtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaaaatcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacgttttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgtaa

SEQ ID NO: 74392 - DNA, 327 bp, Homo sapiens
  misc_feature (16)..(16): n is a, c, g, or t
gaattcaagcttctancgatgtaggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatat

SEQ ID NO: 74393 - DNA, 7989 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74394 - DNA, 8286 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaaaatcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacgttttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgtaa

SEQ ID NO: 74395 - DNA, 7114 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtc

SEQ ID NO: 74396 - DNA, 7592 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74397 - DNA, 6332 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatat

SEQ ID NO: 74398 - DNA, 6583 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74399 - DNA, 6377 bp, Homo sapiens
  misc_feature (13)..(13): n is a, c, g, or t
  misc_feature (15)..(15): n is a, c, g, or t
  misc_feature (6339)..(6339): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatataagatanaagcttatgaaccgtgacctgaggggggccggacccat

SEQ ID NO: 74400 - DNA, 3807 bp, Homo sapiens
gcttgccctgggttcctagaagacaaacatagacagcgagtgtcatggattcttctttttttagaaaaacaacccatgattgtaatatctataatactctgcatctttctttccgtgtcagtccacaaactttgttttagttccgtataggagcaggcgttcggatttgccataggaaattggagagcgtatacgaagagaaagacagagataaacattaccactcaggaaaacccctttatcactttggtctgtctcagtgtctgtggctccctgtctgtttttagacgtgactgtggccagcgaagggccacctcggacctgccgtttcgtcacctggcccctctgttgagcctgttccccttccaggggaggctgaccatgatgtaaagcttcctgtgccatggctgtgctgcgtgctaactggcccaccgtggccgagcatgagacgtggctccctcaaatgccccttcctgtcttcattttcccacagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74401 - DNA, 1669 bp, Homo sapiens
  misc_feature (15)..(15): n is a, c, g, or t
tcagctggtacgccntggggtttggatatgtcgaccacgcgcttctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74402 - DNA, 1682 bp, Homo sapiens
ctactaaattcgcggccgcgtcgacttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74403 - DNA, 1259 bp, Homo sapiens
aagggagttcgtactggtgctaagggagttcgtgctggtgctaagggaattcgtgctggtgctaagggaattcgtgctggtgctaagggaattcgtgctggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74404 - DNA, 4540 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgcccttcaaagttgttataatttgtactgaacttcaaaatgtgtcccgttctccccagaccactctagccacagtatattgcaataaaattacttcttatatttgcagaaaaatcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacgttttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgtaa

SEQ ID NO: 74405 - DNA, 810 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatat

SEQ ID NO: 74406 - DNA, 641 bp, Homo sapiens
cggcagcctcacttgggtcccaggttcaccagtaacccaggggtgcgcgggccgctgacttcccccgccacccccggcaacacccctacccttcagaaagcactgcctgttactgcagtgccggcaagagcaggcgttagggattctttgcaggggcattttcatccagctccccgtcctcaattgtcaccccctttacccgtcacttcagtgcttcagtgctgatgggacgccacagagtgcactgagaaatgataccgggagctcaggggcctgggcttgctgaggcctcgccatgcagaacattcagattcaaactgggcctgcccaagaagcagggacgcagctctctccagcttcagaacgttacagctgggaacgcagagctcatgggaaagccattctcgagggatgggccccaagcccaccccgtccgggccatgtgctgccccccaagcgtgggggacctggtgctgagtgtggttgtttggagcggggaagggaccgccagggaggcgggtcctcttgcctagactagggcactctcttgtcccatattcagggtgaagacggctttcctgggtttaaaggagacatgggcatcaagggtgatcgggtgagcatctcaggtttgggatttg

SEQ ID NO: 74407 - DNA, 6005 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgagggtgacatccagcagctgctctttgtctcggaccaccgggcagcttatgattactgtgagcactacagccctgactgtgacaccgcagtacctgacaccccacagtcgcaggaccccaatccagatgaatattacacggaaggagacggcgagggtgagacctattactacgaatacccctactacgaagaccccgaagacctagggaaggagcccacccccagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaagggattggaggacctcggggcgagaaaggccaaaagggagaaccagcgattatcgagccgggcatgctcatcgagggcccgcctggcccagaaggccccgcgggtcttcccggacctccaggaaccatgggtcccactggccaagtcggggaccctggagaaaggggcccccctggacgcccaggccttcctggggccgatggcctgcccggtcctccaggaaccatgctcatgctgcccttccggtttggaggtggcggcgatgcgggctccaaaggccccatggtctcagcccaggagtcccaggcgcaagccattctccagcaggccaggttggcactgaggggaccagctggcccgatgggtctcacagggagacctggccctgtgggtccccctgggagcggaggtttgaagggcgagccgggagacgtggggcctcagggtcctcgaggtgtgcaaggcccgcctggtccggccgggaagcccggaagacggggtcgggctgggagtgatggagccagaggaatgcctggacaaactggccccaagggtgaccggggtttcgacggcctggctgggttgccaggcgagaagggccacaggggtgaccctggtccttccggcccaccaggacctccgggagacgatggagaaaggggtgacgacggagaagttgggcccagggggctgcctgggaagcccgggccacgtggtctgcttgggccgaaagggcccccaggtcctcccggacctcccggtgtcacgggtatggacggccagccggggccaaaaggaaatgtgggtccccagggagagcctggccccccaggacagcagggtaatccaggcgcccagggtcttccaggcccccagggtgcaattggtcctccaggagaaaagggtcccttggggaaaccaggccttccaggaatgcccggtgctgacggacccccgggacaccctggcaaagaaggccctccaggagagaaaggaggtcagggtccacctggcccccagggtccgattggctacccaggtcctcgaggagtcaagggggccgatggcatccgtggtctgaagggcacaaagggcgagaagggtgaagacggctttcctgggtttaaaggagacatgggcatcaagggtgatcggggggagatcggcccacccggtcccaggggagaagatggccctgaaggcccaaagggtcgcggaggtcccaatggtgaccccggtcctctgggaccccctggggagaagggaaaactcggagtcccagggttaccagggtatccaggaagacaaggaccaaagggctctattggattccctggatttcctggcgccaatggagagaagggcggcagggggacccctggaaagccaggaccgcgggggcagcgaggcccaacgggtccgaggggtgaaagaggcccccggggcatcactgggaagcctggccccaagggcaactccggaggtgacggcccagctggccctcctggtgaacggggacccaatggaccccaaggacccacaggatttcctggaccaaagggcccccctggccctccaggcaaggatggactcccaggacaccctggacagagaggcgagactggtttccaaggcaagaccggccctccaggcccccccggcgtggtcggccctcagggtcccacgggagaaacgggcccaatgggtgagcgtggccaccctgggccccctggaccccccggtgaacaggggcttccgggccttgctggaaaagaagggacgaagggtgacccaggccctgcaggcctccctgggaaagatggccctccaggattacgtggtttccctggggaccgagggcttcctggtccagtgggagctcttggactgaaaggcaatgaagggccccctggcccaccaggccctgcgggatctccaggggagagaggtccagctggagccgctgggcccatcggaattccagggagacctgggccccagggacccccagggccggcaggagagaaaggggctcctggcgagaaaggcccacaaggcccagctggccgagacggtctccaggggcctgtggggctcccgggtccagctggccctgtgggtccccctggagaagacggagataagggagagatcggggagccggggcagaaaggaagcaagggggacaaaggagaacagggtcctcctgggcctacaggtcctcaaggccccatcggacagccaggcccctctggagctgacggcgagccggggcctcggggccagcagggccttttcgggcagaaaggtgatgaaggtcccagaggctttcctggaccccctgggccagtggggctgcagggtttgccaggacctccaggcgagaagggtgagacaggagacgtgggccagatgggccccccgggtccccctggcccccgaggaccctccggagctccaggtgctgatggcccacaaggtcccccaggtggaataggaaaccctggtgcagtgggagagaagggcgagcctggcgaagcaggtgagcctggccttccgggagaaggcggccccccgggacccaaaggagaaaggggagagaagggcgagtcaggcccttcaggtgctgccggaccccctggacccaaaggccctcccggagatgatggtcccaaaggcagccctggcccagtgggttttcctggagatcctggcccccccggagagcctggccccgcgggtcaagatggtccccctggtgacaaaggagatgatggtgaacccgggcagacgggatcccccggccctactggtgaaccaggtccatcggggcctccaggaaaaaggggtcccccaggccccgcaggccccgaaggcagacagggagagaaaggggccaagggagaagccggcttggaaggccctcctgggaagactggccccatcggcccccagggggcccctgggaagcccggaccggatggccttcgagggatccctggccctgtgggagaacaaggtctcccaggatccccaggcccggacggtccccccggccccatgggtcccccaggacttcccggcctcaaaggagattctggtcccaaaggtgaaaagggtcatccaggcctgatcgggctcatcggtcctccgggtgaacagggtgagaagggcgaccgtggtctccctggcccccagggctcctccggtcctaagggagaacagggtatcactggtccttctggcccgattgggcctcctgggccccctggcctgccgggtccgcctggtccaaaaggtgctaagggctcctcgggtccaactggcccgaagggtgaggcaggccacccaggacccccaggccccccgggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcaagaagcccgtggaagctgccaaagaaaccacagaggtccccgaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgaggggatggagcacccat

SEQ ID NO: 74408 - DNA, 3146 bp, Homo sapiens
cgggcggatcatgaggtcaggagatcgagaccatcctggctaacacggtgaaaccccgtctctacttaaaatacaaaaaattagccgggcgtggtggcgggcacctgtagtcccagctgctccagaggctgaggcaggagaatggcatgaacccgggacgcagaacgcgccgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgaatactgggtcgatcctaaccaaggatgctccagggattccttcaaggtttactgcaacttcacagccggggggtcgacatgcgtcttccctgacaagaagtccgaaggggccagaatcacttcttggcccaaagaaaacccgggctcctggttcagtgaattcaagcgtgggaaactgctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgatcctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgtattgtattgttataaatgttaagtgtgcctggctttcaatcatgcacggaaacccagtctcagtcccacggacagaatgggcgaggcatggattctgggttgcagtaccgttctgattagaaataggaagtctccccacccccgccctggccaagaacgtgcaataaattggaagtttgccccggggcagcaagaatttatgctgccattgaaaagcaggtaccagtgccccttttcagacagtttttgattcgctctagactttttttttttttaatagggagggaaaaaatttgataattttcttttttctacatgcacttaagactaaaacacaggtttggattaattttatttgcttcctttttccgcttttcttcccgcagagcctgatgggagaatgtccagggcagggaaaccacattttttgtaggtgataactcaatgaaaattggtgcttattttttacacttctctcttgtggctctcttgtggtgctatctgttttaaggtctccttgaaggcgcactggggtccctggccatgcctcgttctccctgctttctttatcctgttattgcctccacagtctgttgccaaggactctaagatcaatgcacgtcactttcctttccactgggcaggatagccaagcacactccctcctgcgctctcccgccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74409 - DNA, 996 bp, Homo sapiens
ctgattagaaataggaagtctccccggtgcgtccactcccgagggctgttatgaggactgggttgtgcctacttgatttgaaaacacacacaagcaataaaaagcctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaccagaatgcagttccagcttaggaagccacaaacaagccacccaggaggaacaaaacaccgccagcgtggattttccaaatttccctggaaagtaagtctcgctcttgccaaagaaaagtctggcttggagagtctctggagcccaggatgccagcatgtgccaatgactgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcaga

SEQ ID NO: 74410 - DNA, 1327 bp, Homo sapiens
  misc_feature (13)..(13): n is a, c, g, or t
  misc_feature (15)..(15): n is a, c, g, or t
gccgccccgcggncnaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctgcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgacttgtcaccttcatctcttcaaaagaaaagccatagccgaggactgtcccgcgacccccgtggactgcgtctaggtcatgtgattctgttttcatttctcatcccatccaatttgtccttttctcctgtcattttcttcctctgtggtcccttcaaagttgttataatttgtactgaacttcaaaatgtgtcccgttctccccagaccactctagccacagtatattgcaataaaattacttcttatatttgcagaaaaatcttttggtgtaattttattttttcctctcaatatatataattggacaaacgctggcaaaaagaaaaaaatggtaagcaaaaaacccaagataaagtttcgaggacatcaggccttttgaaatacaatgtcaaatgacacattgtacgttttcaaaaaatccgctagacatgtcataagttttaactgtaatgcccaggaaaggatatcttaaaatattctaaacttgtgtaacaaaggaataattaactgtaatagtttttcaataaatcgagttgggtgtttccaccgtaa

SEQ ID NO: 74411 - DNA, 209 bp, Homo sapiens
ctgtgtgtgtccccaccctgctgagccccaacacccctgtccccccagctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgctt

SEQ ID NO: 74412 - DNA, 947 bp, Homo sapiens
gctgagtcaaaccctttgcagtctagaagggtttggtgtgcaggctctgcccacatgggacttccatgccgtttccatttcttccaaaccataatgctctcccttgcagaggtgcagagtagttaggtaaaggaaaatcccccggagtctctccatatctgctacagtgggcttacgcgtttcttgcattttgggggcagatcccagagacaaggagggcggcacatgagcagacatggcaccaggcccctgcccccttgggtcaccctgttccctccccatcccacaacagccgctgaccagagcagctcttccctcacaagccagtttgctccctttgcccctgaggctccacgggctgcagcttcccaggtctggggggtcgcattttcatagcctttgcatgtgtgtgtgtctttaagacatgcccgacagaaacaagagtcttggagatgacacgtaattcacctgccccgtggatcatttcaaacagataacgtgggaaaggtataagaaggtataaagtcatgaaagttgttcttgggaaaaagctcagggaagagttagagcccttccagaatgagccaggtgctaatttagaacagtcacctgcctgccaatgatgatgacgtgctcagccaccaagctgcgggccgggagaggagccgtaataagcgattccaccaagccttccagccactcctttgaaacctctttaaaatgaaatcctgaaataggaccgcatttccacaggcatcaagctgtcagcttcaaaggagaacaggcttctgaggcctggccccttcagcgcgcagctgaggcccccctccccgaggagaggagcagatgtttgagggcagagggcctgtcctgacagcacctgcgtggaggtggcaggaggggattgtttctaggccaggcgagaggagcctggcagcccctggagc

SEQ ID NO: 74413 - DNA, 186 bp, Homo sapiens
accctgtggtctttgtgtctgtgacccaggcccaccctccctacctgagtgacttattcttacctggaacccaagcttctgaccacagaattagcgctctcttccactgtatcagttttctcactcattgtctcttatgtttcgaaagagttgcctcagttgaggaatagccctgaagcctgtcct

SEQ ID NO: 74414 - DNA, 274 bp, Homo sapiens
atgcagaatgactgggccaggattcagacacaaatacaaaccaggatggtgaagggagaggattcagaaggtgaggatgacagtgggactctgtacaggagcccctcacaccctctactcaaaactatcaggtgcatattctgagctaggcacttttgacaggttctctggcttacttggaaaagaatcacatctttaaaaagtgacaacattgtatttacttgtctactttgaaaaatgaaataaacaacccccttggaggaaacagttaact

SEQ ID NO: 74415 - DNA, 1357 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaa

SEQ ID NO: 74416 - DNA, 717 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcagacagtggctgaatggatcaacaaacaagactcaactatatgctgcctagaagaaacttgcttcacttgtaaggacac

SEQ ID NO: 74417 - DNA, 737 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagttctggtgaccaagaaaaaaaggacgatccatccaaggattccaacatttgacgatttactgtttgctcctggcttgtgaccacagaaatccacgcaacaacagcctgttccaaatagcgacgcgttccctgattgttctgcctggttgccactcttttccttggtttgctaagcctgtatcctccacacctcatctcagccactcgttgtatgacttggtctttaacaaatacgtggtctaagaaataaacctcaaa

SEQ ID NO: 74418 - DNA, 382 bp, Homo sapiens
tgctaggattacaggtgtgagccactgcgcccgtcccttttttaactttttagggaaaatataaataaatgtgtagcttgggaaatgagactcttcatttaaagaagtgtgaacttgacacatgattcttagccatatcctaatattttcaaaattagtacaggtgaccaagaaaaaaaagaagaaacaacacaagattccaacaaatgacgaattactgtatgatcctgaaaaagataacagagatcaggcctgggttgatgcacagagaagggggtaagaacttaaagttaatatttagaatctttagaaaaaaagattgaaagatgatttttactacatttccggcacagtatctacattaccggggggatcctcggta

SEQ ID NO: 74419 - DNA, 253 bp, Homo sapiens
gaagtcgccggtcaccgttgggagtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtaagtaacctatttaccagg

SEQ ID NO: 74420 - DNA, 250 bp, Homo sapiens
ctactactacggggtgggcggccgctcgacctcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattcttcatcctcggaatcagaatcagtcgacgcggccgg

SEQ ID NO: 74421 - DNA, 1543 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaaaaaaaaaaaaacaaaaaaaaaaaaaaagaaacaaaaaaaacaacagaaaatagaaaaaacacagagaaaaaatatagaaaaaagaaaaataagaagcacaactaagaaagaaacaaagaagagaagaggagagaaaaaagagagaaaaaaataaaaatgaaagtgatgaaaaacaaagtgtcaaaa

SEQ ID NO: 74422 - DNA, 1656 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcaggtgggctcccgccccaccctggcccccgaggatttgggtcgaggcctggctttggtcgcctccattcgttgcgcctgccgagcctacgcagaccctagcggctcgggagcctgtcgtgcctgttacttgtgcgaagccaaagggctttcctgatggggtcgcgcagtcccggggggaggcggtgccgatgtcgcctgtaggaagagggatattccggaatcacgggggaccgcgtgtaaatcttcaaaagcaatgagatcgaaacctgtctctacaccttagtagcagagtgacggaagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaa

SEQ ID NO: 74423 - DNA, 1334 bp, Homo sapiens
gaagattggaaatatgcagaactggcttattaagtgagaatagctatatgtaatgtataagtacatcaaatgtaaccatgtaatacttaaaattgttgttggacagtgagatgctgggagtttaaaattattttaatttttaaatattcatattctttttgatttaaatgtatgctagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaa

SEQ ID NO: 74424 - DNA, 1027 bp, Homo sapiens
ctagagatccccacacaatgaaaaatggaggacagttatctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaa

SEQ ID NO: 74425 - DNA, 1239 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaa

SEQ ID NO: 74426 - DNA, 1303 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaaactgtcgggctttttattaaagctctgtagaattaaaatgttctggaattataagcaatctttgtttctgagtgttatttttattttggatatagctttgatgtaattaaactggaaactctttcctgaa

SEQ ID NO: 74427 - DNA, 1511 bp, Homo sapiens
gggcgcgcaagggggactgggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtcttaccggagaaagtgaatcatctagtgaagatgaatttgaaaaggagatggaagctgaattaaattctaccatgaaaacaatggaggacaagttatcctctctgggaactggatcttcctcaggaaatggaaaagttgcaacagctccgacaaggtactacgatgatatatattttgattctgattccgaggatgaagacagagcagtacaggtgaccaagaaaaaaaagaagaaacaacacaagattccaacaaatgacgaattactgtatgatcctgaaaaagataacagagatcaggcctgggttgatgcacagagaaggggttaccatggtttgggaccacagagatcacgtcaacaacagcctgttccaaatagtgatgctgtcttgaattgtcctgcctgcatgaccacactttgccttgattgccaaaggcatgaatcatacaaaactcaatatagagcaatgtttgtaatgaattgttctattaacaaagaggaggttctaagatataaagcctcagagaacaggaagaaaaggcgggtccataagaagatgaggtctaaccgggaagatgctgccgagaaggcagagacagatgtggaagaaatctatcacccagtcatgtgcactgaatgttccactgaagtggcagtctacgacaaggatgaagtctttcattttttcaatgttttagcaagccattcctaaacagcccaactggcatttaattacccaatactgtatataaggcaaatatggacagttactttcctcttgcctgttcatatccttcagtgacattgaggaagcagtgtttctctttttaaaggagaatagttgtcaaccttcattcatctcttacatctctcaccctctccttttttttttctttgattttcccccttattgatgggactgatattcattctgtttttgatgaacatttggaattaaaatgttctggaattataagcaatctttgtttctgagtgttatttttattttggatatagctttgatgtaattaaactggaaactctttcctgaaaaaaaaaaaaacaaaaaaaaaaaaaaagaaacaaaaaaaacaacagaaaatagaaaaaacacagagaaaaaatatagaaaaaagaaaaataagaagcacaactaagaaagaaacaaagaagagaagaggagagaaaaaagagagaaaaaaataaaaatgaaagtgatgaaaaacaaagtgtcaaaa

SEQ ID NO: 74428 - DNA, 481 bp, Homo sapiens
atattttcgtttgttcagtgtcctagaaacaaccacatgctggagaatggaattccataaggtactctcttagataaaggaagtgccagccatcctgttgccatctgctaaaatcctcagcccacctgcatagtgaacagcattcattgttttccagaaatgtgcaagaaccacagtctcccccaagactgaagatctgcttcatcgacatggcagggaacgtggctgaacacagaggactcatttttgcagcttccctaccagagagagagagacaccctttttacccgagttctgagttgaaatatcctagaagagaactctgattggcctggcttgggtcacatgcctgtccttgagttgatcaactgtgattagttataagtgtactcattagtaacttcccctggaaccttagatttgatgtggggtaagacttccaaaaacaaacaaaaaaataaaacagaagaatgctaaaaat

SEQ ID NO: 74429 - DNA, 889 bp, Homo sapiens
ttagatggagtttgctcttgttgctcaggctggaatgcaatggcatgatctcagcttactgcgacctctgcctcccagattcaagtgatgctctgcctcagcctcctgagtagctgggattacaggcgtgcactgccatgcctggctaatttttgaattattagtagagatggggtttcaccatgttggtcacgctggtcttgaactccctacctcaggtgatgtacccacttcagccttccaaagttctgggattacaggcatgagccaccatgtctggcctagagtgtccactttctttacagaaatttctgagttcattgattcgacttatatttaaaatataaaaaaatctttattatatttataatagtcatttaaaacacttgcctgcaaatttcaatggttaggtcttctgtgtttctccttgtatttactatttctctttactatatttcatgtcttttttcttctgccatgtctcatatttaatgtatgctggattttgcaaaaatagcagtaaagactgatgttaaaccttctttctgttaagttttgttttgtttcccaaattagactgactctatttctactttcaagtgggttctgccctatccagattttcccatgttctgcagagggttgaatctcttagatctgtcagaagttcagctgagagggaaatagattacagttctgcctagttttgactcacttttgaattcaacttcaatagagccataggtacaaatatcacaagtgtatgcaagattgaacacttttcactttcgaaccctacttctactgttttcttataaacatccatgaagaagagaaaaatgcttaaaatgaaggttttatttctatatttgtgacttttctagattcc

SEQ ID NO: 74430 - DNA, 6797 bp, Homo sapiens
  misc_feature (4364)..(4364): n is a, c, g, or t
  misc_feature (4421)..(4421): n is a, c, g, or t
  misc_feature (4430)..(4430): n is a, c, g, or t
  misc_feature (4567)..(4567): n is a, c, g, or t
  misc_feature (4701)..(4701): n is a, c, g, or t
  misc_feature (4860)..(4860): n is a, c, g, or t
  misc_feature (5008)..(5008): n is a, c, g, or t
  misc_feature (5438)..(5438): n is a, c, g, or t
agttctctcttatttgatatcagagagcccaatggagccttctgaagtacctagtcagattagcaaagataattttttagaagttcctaatttatctgactctctttgtgaagatgaagaagttactttccaacctggtttctcccctcaaccaagtagacgaggttctgattcttctgaagacatatacctggataccccatcttcaggtactagaagagtttcatttgctgattcctttggattcaatcttgtgtctgttaaagaatttgattgctgggaattaccgagtgcttcaaccacttttgacttagggacggacattttccacacagaagaatatgttttagccccactgtttgacttgccttcttcaaaagaagatcttatgcaacaactccaaatacagaaagcaatactggagtcaactgagtctcttcttgggtctacaagtatcaagggtattattcgagttttgaatgtttcttttgagaagttagtatatgtaagaatgtctttagatgactggcagacacattatgacattttagcagaatatgttcctaattcatgtgatggtgaaactgaccagttctcctttaagattgtattggttcctccttatcaaaaagatggcagtaaagttgagttttgtatacgttatgaaacttctgttggtacattttggtcaaataataatggcacaaattatacattcatttgtcaaaagaaagaacaagagccggagcctgtaaaaccatggaaagaagttcctaacagacaaataaaaggctgcttaaaggtaaaatcaagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacaatgcaaataccttgcccctcttcagatcaactaatggcaggaaaccttaataaaaaacatgaaggaggagctaaaaaaattgaagtaaaagatttgggatgtttacgaagagatttccattcagatacgtcggcatgtctcaaagaatcaacagaagaaggatcttctaaggaagattattatggcaatggtaaggatgatgaagaacaaagaatatatttaggtgttaatgaaaaacaaagaaaaaatttccaaacaatcttacatgaccaagaaaggaagatgggtaaccctaaaataagtgtggcagggattggagctagtaacagagacctggctactctgctgagcgaacataccgcaatccccacccgggcaatcacagcagatgtgtctcattcaccaaggacaaatttaagttgggaagaagctgtgttaaccccagagcatcatcatttgactagtgaaggcagcgctttaggagggataactggtcaagtttgttcatcaagaactggaaatgttttgaggaatgattatcttttccaagttgaagaaaaatcaggtgggattaattctgaagatcaggataatagcccacagcataaacaaagttggaatgttctggaaagtcagggaaaatcaagagagaataagacaaacataacagagcatatcaaaggacaaacagattgtgaagacgtgtggggaaaaagagataatacgaggagtttgaaagctactacagaagaattgtttacctgccaagaaacagtgtgctgtgaactgtcttctctagctgatcatggcattactgagaaagcagaagctggtacagcctatataattaagacaacatcagaaagtactccagaaagcatgtctgctagagaaaaagcaataattgctaagctacctcaagagacagcacgaagtgacaggcccatcgaggtaaaggaaacagcgtttgatccacatgaagggagaaatgatgattcacattataccctttgtcaacgagatacagtaggtgtaatctatgacaatgattttgaaaaggaatcacgtttaggtatttgtaatgtacgtgtagatgaaatggagaaggaagaaaccatgtctatgtacaatcctaggaagacacatgacagggagaaatgtggcactggaaatataacatctgtggaagaatcctcatgggtcattacagaatatcaaaaagcaacttcaaaactggatttacagttgggaatgttaccaacagacaaaactgtattttcagaaaacagagatcataggcaggttcaagaattatcaaagaaaacagactcggatgccattgtgcattctgcttttaactcagacactaatagagctcctcagaatagctctcctttttccaaacatcatactgaaatttcagtgtcaactaatgagcaggcaattgctgtagagaatgcagttactaccatggctagccaacctatttctacgaaatcagaaaatatttgtaattcaacaagagaaatccagggtattgagaagcacccttatcctgagtctaaacctgaagaagtttccagaagttcaggaatagtgacatcaggtagtagaaaagaaagatgcataggccagattttccaaacagaagagtatagtgtggaaaaatctctagggccaatgattttaatcaacaaacctcttgagaatatggaagaagcaaggcatgaaaatgaaggattagtaagctctgggcaatcactatacacttcaggtgaaaaggaatctgacagctctgcttctactagtcttcctgttgaggaaagtcaagctcaaggcaacgaatctttgttttcaaaatataccaactctaaaataccttatttccttttgtttctgatatttcttataactgtctaccattatgacttaatgattggcttgacattctacgttttgtcattgtcctggctatcctgggaagagggtagacaaaaagagtctgtcaaaaagaagtaacctcagcactactattctctcttaaaagataagctatttaaccccaaacatttggattggtgaatgggactattcattgttcaaagatccagtgcagtttttctcttgaaggatcatttaaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaacaattgggagattatctttcaattctgaaaaattctgtgggtggcctgtctttaagcaatgcttttctcttgtgagggaagactgtaacacagctgaactatttcagtgtcaactattcagaattgaaaatgtaaattaaaatttccacaagcattgcttcagaatgaatttgtacctataaagcataaggcattaaatgacaataaaaattccaaatggactatttgttccacattgtatttttgtcttcaaatattttctaagagaatgaattatcccccaaaatgcatttanaaaacagtctttggtgatatttattatatgattatcaggttgttagatgataactcnaaattttcngtaggcaaataggtaatgtggaaatctgaagaagaaatgaatatccagtatagcagtgactttgactgctgttattacctatagctaagtgtgtatgataatgaaactcatcattttagtcaagtagaggcaatgcnaagattcacatagtttatttcaactatttattgaatgattactatatgcaaaactctgtgctctgttctgtggcatagaacttcctttgatatgctgcatagctagttctaggcataggtacgtagtgtgacanttctgacttcactgaaattatggaagaaagacacccagaggaggcctctttggttggttcttttttcataggaaattccttcataaaacatgtaacactgatcttcagatagaaaaagcaatctgtttatttacctgtaagggcaaagtcaatgagtanaacttgcatatgtcatcccatataactaagacatatgcatttatgggaagacaaaacaagaatgaaacacttatactgactttcatctggtagtagatgatttccttaatttttattaggtacgtaactatttccaaatcctctaatngcatactactctcaagtcccattgaaaatgaatgcttgacttcaactttttagttgaccaaatacaaacatcctaaagtagagcttagggcaaatatttgattgagagggcacaatttcattcagtacaagagaagtactgtaagcagtacctagaaataatctctaaaattgctatcctgataattttgttgacaggtctaaattacaatgaagttaaggttaggatttccttagttcttaatgtctcagtttttgaattctacctttaagggttttagtcaacatgccatatctcattattgcagagaacactacattactttatgaacacaggtgtctgagctagaattattctcttaaaagacaacataactttttatgtcttttatttactttttggtaatattaacttaccaaatcttctcctntgcatttttaatatgacaaaacaaattttaaaagatttgaaataattgtatttctctgaattcagtgaagaaataattcatgattcaactgcatctccaaacattactcatgaccttgaaataaaataggaacctatgaaactattgatatgtgaatagatgggttatttcaacctgttttggtcacatcactatgccgagcaagaaaagtggatctcagggaggactagcagcccctggttaagggagatctggctgtgagtcatcatggcaagggtaatctttacaagcatagctgcctgcactctgtctctccaagtactggttaaggcccaaatgaaggcatgtcaggagagttagaggtgcatcacacatccgcttcatatgttgggtaagaaacataacttagtctttattttgctgggcttctgacttttagaaacaaaattctaaaaatttgcaagtcaagtaagtgtgggtagcaaaaacaattatctttaaaaaaaaaatcacatcagtataggccatcaatatcacaatagatttctcaaggtaagagaaaataagctcatgagatgacattcacccttcaacataaaagaacattgggttaatgcagccttggtttcctgctgagctccagtattttgatagttaattatttcaactaatatatctatgtctatatcatctatcaatttattaagcaggtctatctttaatttgttatctcaaaccagtctgctggttaaatggaaacttaaaaatatccatggcaagctttgtatataaatgaacaaaaaagcaagcaaagcaaaacaataaactagcagaagaactagtaaaaatacaagcagattcctctactgatttctgtttttgtgatctctgactttcctttcaaatttttactgagaatatcgaaattggattatgcaataggatcttatttagttatttgaatctgtcttagccagttcctgtagaactgagaaataagattgactttgaatctgcaacaagatctgaaataaatgagaagccaagctcttcaagcacctctatctctgtactcctatatgaagagaacagtaaaaaaaattactggtatttatttggttaaattcatttgcttattttttctgtttttggaaataatttgtaataaaaatcatggcaacataattcactttccatcttttaaaaatatattttgccattaatccaatatgtttccatcactttgccaaaacctatttaaaacagtgaattaaattttcactaggtttgaatgatcatgttttataagaaatgtctttattttagtgtgttaaaaccttattaaacaaacaactgttt

SEQ ID NO: 74431 - DNA, 6276 bp, Homo sapiens
  misc_feature (3843)..(3843): n is a, c, g, or t
  misc_feature (3900)..(3900): n is a, c, g, or t
  misc_feature (3909)..(3909): n is a, c, g, or t
  misc_feature (4046)..(4046): n is a, c, g, or t
  misc_feature (4180)..(4180): n is a, c, g, or t
  misc_feature (4339)..(4339): n is a, c, g, or t
  misc_feature (4487)..(4487): n is a, c, g, or t
  misc_feature (4917)..(4917): n is a, c, g, or t
agttctctcttatttgatatcagagagcccaatggagccttctgaagtacctagtcagattagcaaagataattttttagaagttcctaatttatctgactctctttgtgaagatgaagaagttactttccaacctggtttctcccctcaaccaagtagacgaggttctgattcttctgaagacatatacctggataccccatcttcagaaagaacaagagccggagcctgtaaaaccatggaaagaagttcctaacagacaaataaaaggctgcttaaaggtaaaatcaagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacaatgcaaataccttgcccctcttcagatcaactaatggcaggaaaccttaataaaaaacatgaaggaggagctaaaaaaattgaagtaaaagatttgggatgtttacgaagagatttccattcagatacgtcggcatgtctcaaagaatcaacagaagaaggatcttctaaggaagattattatggcaatggtaaggatgatgaagaacaaagaatatatttaggtgttaatgaaaaacaaagaaaaaatttccaaacaatcttacatgaccaagaaaggaagatgggtaaccctaaaataagtgtggcagggattggagctagtaacagagacctggctactctgctgagcgaacataccgcaatccccacccgggcaatcacagcagatgtgtctcattcaccaaggacaaatttaagttgggaagaagctgtgttaaccccagagcatcatcatttgactagtgaaggcagcgctttaggagggataactggtcaagtttgttcatcaagaactggaaatgttttgaggaatgattatcttttccaagttgaagaaaaatcaggtgggattaattctgaagatcaggataatagcccacagcataaacaaagttggaatgttctggaaagtcagggaaaatcaagagagaataagacaaacataacagagcatatcaaaggacaaacagattgtgaagacgtgtggggaaaaagagataatacgaggagtttgaaagctactacagaagaattgtttacctgccaagaaacagtgtgctgtgaactgtcttctctagctgatcatggcattactgagaaagcagaagctggtacagcctatataattaagacaacatcagaaagtactccagaaagcatgtctgctagagaaaaagcaataattgctaagctacctcaagagacagcacgaagtgacaggcccatcgaggtaaaggaaacagcgtttgatccacatgaagggagaaatgatgattcacattataccctttgtcaacgagatacagtaggtgtaatctatgacaatgattttgaaaaggaatcacgtttaggtatttgtaatgtacgtgtagatgaaatggagaaggaagaaaccatgtctatgtacaatcctaggaagacacatgacagggagaaatgtggcactggaaatataacatctgtggaagaatcctcatgggtcattacagaatatcaaaaagcaacttcaaaactggatttacagttgggaatgttaccaacagacaaaactgtattttcagaaaacagagatcataggcaggttcaagaattatcaaagaaaacagactcggatgccattgtgcattctgcttttaactcagacactaatagagctcctcagaatagctctcctttttccaaacatcatactgaaatttcagtgtcaactaatgagcaggcaattgctgtagagaatgcagttactaccatggctagccaacctatttctacgaaatcagaaaatatttgtaattcaacaagagaaatccagggtattgagaagcacccttatcctgagtctaaacctgaagaagtttccagaagttcaggaatagtgacatcaggtagtagaaaagaaagatgcataggccagattttccaaacagaagagtatagtgtggaaaaatctctagggccaatgattttaatcaacaaacctcttgagaatatggaagaagcaaggcatgaaaatgaaggattagtaagctctgggcaatcactatacacttcaggtgaaaaggaatctgacagctctgcttctactagtcttcctgttgaggaaagtcaagctcaaggcaacgaatctttgttttcaaaatataccaactctaaaataccttatttccttttgtttctgatatttcttataactgtctaccattatgacttaatgattggcttgacattctacgttttgtcattgtcctggctatcctgggaagagggtagacaaaaagagtctgtcaaaaagaagtaacctcagcactactattctctcttaaaagataagctatttaaccccaaacatttggattggtgaatgggactattcattgttcaaagatccagtgcagtttttctcttgaaggatcatttaaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaacaattgggagattatctttcaattctgaaaaattctgtgggtggcctgtctttaagcaatgcttttctcttgtgagggaagactgtaacacagctgaactatttcagtgtcaactattcagaattgaaaatgtaaattaaaatttccacaagcattgcttcagaatgaatttgtacctataaagcataaggcattaaatgacaataaaaattccaaatggactatttgttccacattgtatttttgtcttcaaatattttctaagagaatgaattatcccccaaaatgcatttanaaaacagtctttggtgatatttattatatgattatcaggttgttagatgataactcnaaattttcngtaggcaaataggtaatgtggaaatctgaagaagaaatgaatatccagtatagcagtgactttgactgctgttattacctatagctaagtgtgtatgataatgaaactcatcattttagtcaagtagaggcaatgcnaagattcacatagtttatttcaactatttattgaatgattactatatgcaaaactctgtgctctgttctgtggcatagaacttcctttgatatgctgcatagctagttctaggcataggtacgtagtgtgacanttctgacttcactgaaattatggaagaaagacacccagaggaggcctctttggttggttcttttttcataggaaattccttcataaaacatgtaacactgatcttcagatagaaaaagcaatctgtttatttacctgtaagggcaaagtcaatgagtanaacttgcatatgtcatcccatataactaagacatatgcatttatgggaagacaaaacaagaatgaaacacttatactgactttcatctggtagtagatgatttccttaatttttattaggtacgtaactatttccaaatcctctaatngcatactactctcaagtcccattgaaaatgaatgcttgacttcaactttttagttgaccaaatacaaacatcctaaagtagagcttagggcaaatatttgattgagagggcacaatttcattcagtacaagagaagtactgtaagcagtacctagaaataatctctaaaattgctatcctgataattttgttgacaggtctaaattacaatgaagttaaggttaggatttccttagttcttaatgtctcagtttttgaattctacctttaagggttttagtcaacatgccatatctcattattgcagagaacactacattactttatgaacacaggtgtctgagctagaattattctcttaaaagacaacataactttttatgtcttttatttactttttggtaatattaacttaccaaatcttctcctntgcatttttaatatgacaaaacaaattttaaaagatttgaaataattgtatttctctgaattcagtgaagaaataattcatgattcaactgcatctccaaacattactcatgaccttgaaataaaataggaacctatgaaactattgatatgtgaatagatgggttatttcaacctgttttggtcacatcactatgccgagcaagaaaagtggatctcagggaggactagcagcccctggttaagggagatctggctgtgagtcatcatggcaagggtaatctttacaagcatagctgcctgcactctgtctctccaagtactggttaaggcccaaatgaaggcatgtcaggagagttagaggtgcatcacacatccgcttcatatgttgggtaagaaacataacttagtctttattttgctgggcttctgacttttagaaacaaaattctaaaaatttgcaagtcaagtaagtgtgggtagcaaaaacaattatctttaaaaaaaaaatcacatcagtataggccatcaatatcacaatagatttctcaaggtaagagaaaataagctcatgagatgacattcacccttcaacataaaagaacattgggttaatgcagccttggtttcctgctgagctccagtattttgatagttaattatttcaactaatatatctatgtctatatcatctatcaatttattaagcaggtctatctttaatttgttatctcaaaccagtctgctggttaaatggaaacttaaaaatatccatggcaagctttgtatataaatgaacaaaaaagcaagcaaagcaaaacaataaactagcagaagaactagtaaaaatacaagcagattcctctactgatttctgtttttgtgatctctgactttcctttcaaatttttactgagaatatcgaaattggattatgcaataggatcttatttagttatttgaatctgtcttagccagttcctgtagaactgagaaataagattgactttgaatctgcaacaagatctgaaataaatgagaagccaagctcttcaagcacctctatctctgtactcctatatgaagagaacagtaaaaaaaattactggtatttatttggttaaattcatttgcttattttttctgtttttggaaataatttgtaataaaaatcatggcaacataattcactttccatcttttaaaaatatattttgccattaatccaatatgtttccatcactttgccaaaacctatttaaaacagtgaattaaattttcactaggtttgaatgatcatgttttataagaaatgtctttattttagtgtgttaaaaccttattaaacaaacaactgttt

SEQ ID NO: 74432 - DNA, 5125 bp, Homo sapiens
  misc_feature (2692)..(2692): n is a, c, g, or t
  misc_feature (2749)..(2749): n is a, c, g, or t
  misc_feature (2758)..(2758): n is a, c, g, or t
  misc_feature (2895)..(2895): n is a, c, g, or t
  misc_feature (3029)..(3029): n is a, c, g, or t
  misc_feature (3188)..(3188): n is a, c, g, or t
  misc_feature (3336)..(3336): n is a, c, g, or t
  misc_feature (3766)..(3766): n is a, c, g, or t
agttctctcttatttgatatcagagagcccaatggagccttctgaagtacctagtcagattagcaaagataattttttagaagttcctaatttatctgactctctttgtgaagatgaagaagttactttccaacctggtttctcccctcaaccaagtagacgaggttctgattcttctgaagacatatacctggataccccatcttcagaaagaacaagagccggagcctgtaaaaccatggaaagaagttcctaacagacaaataaaaggctgcttaaaggtaaaatcaagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacaatgcaaataccttgcccctcttcagatcaactaatggcaggaaaccttaataaaaaacatgaaggaggagctaaaaaaattgaagtaaaagatttgggatgtttacgaagagatttccattcagatacgtcggcatgtctcaaagaatcaacagaagaaggatcttctaaggaagattattatggcaatggtaaggatgatgaagaacaaagaatatatttaggtgttaatgaaaaacaaagaaaaaatttccaaacaatcttacatgaccaagaaaggaagatgggtaaccctaaaataagtgtggcagggattggagctagtaacagagacctggctactctgctgagcgaacataccgcaatccccacccgggcaatcacagcagatgtgtctcattcaccaaggacaaatttaagttgggaagaagctgtgttaaccccagagcatcatcatttgactagtgaaggcagcgctttaggagggataactggtcaagtttgttcatcaagaactggaaatgttttgaggaatgattatcttttccaagttgaagaaaaatcaggtgggattaattctgaagatcaggataatagcccacagcataaacaaagttggaatgttctggaaagtcagggaaaatcaagagagaataagacaaacataacagagcatatcaaaggacaaacagattgtgaagacgtgtggggaaaaagagataatacgaggagtttgaaagctactacagaagaattgtttacctgccaagaaacagtgtgctgtgaactgtcttctctagctgatcatggcattactgagaaagcagaagctggtacagcctatataattaagacaacatcagaaagtactccagaaagcatgtctgctagagaaaaagcaataattgctaagctacctcaagagacagcacgaagtgacaggcccatcgaggtaaaggaaacagctttttctcttgaaggatcatttaaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaacaattgggagattatctttcaattctgaaaaattctgtgggtggcctgtctttaagcaatgcttttctcttgtgagggaagactgtaacacagctgaactatttcagtgtcaactattcagaattgaaaatgtaaattaaaatttccacaagcattgcttcagaatgaatttgtacctataaagcataaggcattaaatgacaataaaaattccaaatggactatttgttccacattgtatttttgtcttcaaatattttctaagagaatgaattatcccccaaaatgcatttanaaaacagtctttggtgatatttattatatgattatcaggttgttagatgataactcnaaattttcngtaggcaaataggtaatgtggaaatctgaagaagaaatgaatatccagtatagcagtgactttgactgctgttattacctatagctaagtgtgtatgataatgaaactcatcattttagtcaagtagaggcaatgcnaagattcacatagtttatttcaactatttattgaatgattactatatgcaaaactctgtgctctgttctgtggcatagaacttcctttgatatgctgcatagctagttctaggcataggtacgtagtgtgacanttctgacttcactgaaattatggaagaaagacacccagaggaggcctctttggttggttcttttttcataggaaattccttcataaaacatgtaacactgatcttcagatagaaaaagcaatctgtttatttacctgtaagggcaaagtcaatgagtanaacttgcatatgtcatcccatataactaagacatatgcatttatgggaagacaaaacaagaatgaaacacttatactgactttcatctggtagtagatgatttccttaatttttattaggtacgtaactatttccaaatcctctaatngcatactactctcaagtcccattgaaaatgaatgcttgacttcaactttttagttgaccaaatacaaacatcctaaagtagagcttagggcaaatatttgattgagagggcacaatttcattcagtacaagagaagtactgtaagcagtacctagaaataatctctaaaattgctatcctgataattttgttgacaggtctaaattacaatgaagttaaggttaggatttccttagttcttaatgtctcagtttttgaattctacctttaagggttttagtcaacatgccatatctcattattgcagagaacactacattactttatgaacacaggtgtctgagctagaattattctcttaaaagacaacataactttttatgtcttttatttactttttggtaatattaacttaccaaatcttctcctntgcatttttaatatgacaaaacaaattttaaaagatttgaaataattgtatttctctgaattcagtgaagaaataattcatgattcaactgcatctccaaacattactcatgaccttgaaataaaataggaacctatgaaactattgatatgtgaatagatgggttatttcaacctgttttggtcacatcactatgccgagcaagaaaagtggatctcagggaggactagcagcccctggttaagggagatctggctgtgagtcatcatggcaagggtaatctttacaagcatagctgcctgcactctgtctctccaagtactggttaaggcccaaatgaaggcatgtcaggagagttagaggtgcatcacacatccgcttcatatgttgggtaagaaacataacttagtctttattttgctgggcttctgacttttagaaacaaaattctaaaaatttgcaagtcaagtaagtgtgggtagcaaaaacaattatctttaaaaaaaaaatcacatcagtataggccatcaatatcacaatagatttctcaaggtaagagaaaataagctcatgagatgacattcacccttcaacataaaagaacattgggttaatgcagccttggtttcctgctgagctccagtattttgatagttaattatttcaactaatatatctatgtctatatcatctatcaatttattaagcaggtctatctttaatttgttatctcaaaccagtctgctggttaaatggaaacttaaaaatatccatggcaagctttgtatataaatgaacaaaaaagcaagcaaagcaaaacaataaactagcagaagaactagtaaaaatacaagcagattcctctactgatttctgtttttgtgatctctgactttcctttcaaatttttactgagaatatcgaaattggattatgcaataggatcttatttagttatttgaatctgtcttagccagttcctgtagaactgagaaataagattgactttgaatctgcaacaagatctgaaataaatgagaagccaagctcttcaagcacctctatctctgtactcctatatgaagagaacagtaaaaaaaattactggtatttatttggttaaattcatttgcttattttttctgtttttggaaataatttgtaataaaaatcatggcaacataattcactttccatcttttaaaaatatattttgccattaatccaatatgtttccatcactttgccaaaacctatttaaaacagtgaattaaattttcactaggtttgaatgatcatgttttataagaaatgtctttattttagtgtgttaaaaccttattaaacaaacaactgttt

SEQ ID NO: 74433 - DNA, 6765 bp, Homo sapiens
  misc_feature (4332)..(4332): n is a, c, g, or t
  misc_feature (4389)..(4389): n is a, c, g, or t
  misc_feature (4398)..(4398): n is a, c, g, or t
  misc_feature (4535)..(4535): n is a, c, g, or t
  misc_feature (4669)..(4669): n is a, c, g, or t
  misc_feature (4828)..(4828): n is a, c, g, or t
  misc_feature (4976)..(4976): n is a, c, g, or t
  misc_feature (5406)..(5406): n is a, c, g, or t
agcagtggcaacttgctggggtccccttccacggtgtggaagctttgttctctcgctctttacaataaatcttgctactgctcactctttgggtccacactgcctttatgagctgtaacactcaccctgaaggtctgcagcttcactcctgaagccagcaagaccatgagcccaccgagaagaacgaacaactccagacgcgccgcctaaagagctgtaacgctcactgcgaaggtctgcagcttcactcctgagccagggagaccacgaacccaccagaaggaagaaactccgaacacatctgaacatcagaaggaacaaactccggacacgcagcctttaagaactgtaacactcaccgcgagggtccgcggcttcattcttgacgtcagtgagaccaagaacccaccaattccaggcacaatagttccaggctctgttattgtggctaataatataaggcctaggtgacagtatggcacttctgagtttaagttatgaaagatggtggctttcatttaggtctctggatctctctctctatcactttatctgccaagctgctgtgttttaagcagccctctagagagacttttatggtaaggaagtatagtattatactatctggccaatagccagagaagaattgagatctcccaacaaccatgtgactgaacttggaagcagacccttctttcccagctgaatcttcttgagatgtctggagccctggctaacagcttaataacctcaagagagaatctgggcaagaacgactcagtaaagaagaatcatcagtaacatcagaagaaaataactttgagaatccaaagaatacagatacctatatcccaacaatcatttgttctcatgaggacaaggaagatttggaagccagtaatcgaaatgtaaaagatgtaaacagggaacatgatgaacataatgaaaaagaattagagttgatgataaatcaacacttaataagaaccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatattcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacaatgcaaataccttgcccctcttcagatcaactaatggcaggaaaccttaataaaaaacatgaaggaggagctaaaaaaattgaagtaaaagatttgggatgtttacgaagagatttccattcagatacgtcggcatgtctcaaagaatcaacagaagaaggatcttctaaggaagattattatggcaatggtaaggatgatgaagaacaaagaatatatttaggtgttaatgaaaaacaaagaaaaaatttccaaacaatcttacatgaccaagaaaggaagatgggtaaccctaaaataagtgtggcagggattggagctagtaacagagacctggctactctgctgagcgaacataccgcaatccccacccgggcaatcacagcagatgtgtctcattcaccaaggacaaatttaagttgggaagaagctgtgttaaccccagagcatcatcatttgactagtgaaggcagcgctttaggagggataactggtcaagtttgttcatcaagaactggaaatgttttgaggaatgattatcttttccaagttgaagaaaaatcaggtgggattaattctgaagatcaggataatagcccacagcataaacaaagttggaatgttctggaaagtcagggaaaatcaagagagaataagacaaacataacagagcatatcaaaggacaaacagattgtgaagacgtgtggggaaaaagagataatacgaggagtttgaaagctactacagaagaattgtttacctgccaagaaacagtgtgctgtgaactgtcttctctagctgatcatggcattactgagaaagcagaagctggtacagcctatataattaagacaacatcagaaagtactccagaaagcatgtctgctagagaaaaagcaataattgctaagctacctcaagagacagcacgaagtgacaggcccatcgaggtaaaggaaacagcgtttgatccacatgaagggagaaatgatgattcacattataccctttgtcaacgagatacagtaggtgtaatctatgacaatgattttgaaaaggaatcacgtttaggtatttgtaatgtacgtgtagatgaaatggagaaggaagaaaccatgtctatgtacaatcctaggaagacacatgacagggagaaatgtggcactggaaatataacatctgtggaagaatcctcatgggtcattacagaatatcaaaaagcaacttcaaaactggatttacagttgggaatgttaccaacagacaaaactgtattttcagaaaacagagatcataggcaggttcaagaattatcaaagaaaacagactcggatgccattgtgcattctgcttttaactcagacactaatagagctcctcagaatagctctcctttttccaaacatcatactgaaatttcagtgtcaactaatgagcaggcaattgctgtagagaatgcagttactaccatggctagccaacctatttctacgaaatcagaaaatatttgtaattcaacaagagaaatccagggtattgagaagcacccttatcctgagtctaaacctgaagaagtttccagaagttcaggaatagtgacatcaggtagtagaaaagaaagatgcataggccagattttccaaacagaagagtatagtgtggaaaaatctctagggccaatgattttaatcaacaaacctcttgagaatatggaagaagcaaggcatgaaaatgaaggattagtaagctctgggcaatcactatacacttcaggtgaaaaggaatctgacagctctgcttctactagtcttcctgttgaggaaagtcaagctcaaggcaacgaatctttgttttcaaaatataccaactctaaaataccttatttccttttgtttctgatatttcttataactgtctaccattatgacttaatgattggcttgacattctacgttttgtcattgtcctggctatcctgggaagagggtagacaaaaagagtctgtcaaaaagaagtaacctcagcactactattctctcttaaaagataagctatttaaccccaaacatttggattggtgaatgggactattcattgttcaaagatccagtgcagtttttctcttgaaggatcatttaaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgtatttaacactgtatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaacaattgggagattatctttcaattctgaaaaattctgtgggtggcctgtctttaagcaatgcttttctcttgtgagggaagactgtaacacagctgaactatttcagtgtcaactattcagaattgaaaatgtaaattaaaatttccacaagcattgcttcagaatgaatttgtacctataaagcataaggcattaaatgacaataaaaattccaaatggactatttgttccacattgtatttttgtcttcaaatattttctaagagaatgaattatcccccaaaatgcatttanaaaacagtctttggtgatatttattatatgattatcaggttgttagatgataactcnaaattttcngtaggcaaataggtaatgtggaaatctgaagaagaaatgaatatccagtatagcagtgactttgactgctgttattacctatagctaagtgtgtatgataatgaaactcatcattttagtcaagtagaggcaatgcnaagattcacatagtttatttcaactatttattgaatgattactatatgcaaaactctgtgctctgttctgtggcatagaacttcctttgatatgctgcatagctagttctaggcataggtacgtagtgtgacanttctgacttcactgaaattatggaagaaagacacccagaggaggcctctttggttggttcttttttcataggaaattccttcataaaacatgtaacactgatcttcagatagaaaaagcaatctgtttatttacctgtaagggcaaagtcaatgagtanaacttgcatatgtcatcccatataactaagacatatgcatttatgggaagacaaaacaagaatgaaacacttatactgactttcatctggtagtagatgatttccttaatttttattaggtacgtaactatttccaaatcctctaatngcatactactctcaagtcccattgaaaatgaatgcttgacttcaactttttagttgaccaaatacaaacatcctaaagtagagcttagggcaaatatttgattgagagggcacaatttcattcagtacaagagaagtactgtaagcagtacctagaaataatctctaaaattgctatcctgataattttgttgacaggtctaaattacaatgaagttaaggttaggatttccttagttcttaatgtctcagtttttgaattctacctttaagggttttagtcaacatgccatatctcattattgcagagaacactacattactttatgaacacaggtgtctgagctagaattattctcttaaaagacaacataactttttatgtcttttatttactttttggtaatattaacttaccaaatcttctcctntgcatttttaatatgacaaaacaaattttaaaagatttgaaataattgtatttctctgaattcagtgaagaaataattcatgattcaactgcatctccaaacattactcatgaccttgaaataaaataggaacctatgaaactattgatatgtgaatagatgggttatttcaacctgttttggtcacatcactatgccgagcaagaaaagtggatctcagggaggactagcagcccctggttaagggagatctggctgtgagtcatcatggcaagggtaatctttacaagcatagctgcctgcactctgtctctccaagtactggttaaggcccaaatgaaggcatgtcaggagagttagaggtgcatcacacatccgcttcatatgttgggtaagaaacataacttagtctttattttgctgggcttctgacttttagaaacaaaattctaaaaatttgcaagtcaagtaagtgtgggtagcaaaaacaattatctttaaaaaaaaaatcacatcagtataggccatcaatatcacaatagatttctcaaggtaagagaaaataagctcatgagatgacattcacccttcaacataaaagaacattgggttaatgcagccttggtttcctgctgagctccagtattttgatagttaattatttcaactaatatatctatgtctatatcatctatcaatttattaagcaggtctatctttaatttgttatctcaaaccagtctgctggttaaatggaaacttaaaaatatccatggcaagctttgtatataaatgaacaaaaaagcaagcaaagcaaaacaataaactagcagaagaactagtaaaaatacaagcagattcctctactgatttctgtttttgtgatctctgactttcctttcaaatttttactgagaatatcgaaattggattatgcaataggatcttatttagttatttgaatctgtcttagccagttcctgtagaactgagaaataagattgactttgaatctgcaacaagatctgaaataaatgagaagccaagctcttcaagcacctctatctctgtactcctatatgaagagaacagtaaaaaaaattactggtatttatttggttaaattcatttgcttattttttctgtttttggaaataatttgtaataaaaatcatggcaacataattcactttccatcttttaaaaatatattttgccattaatccaatatgtttccatcactttgccaaaacctatttaaaacagtgaattaaattttcactaggtttgaatgatcatgttttataagaaatgtctttattttagtgtgttaaaaccttattaaacaaacaactgttt

SEQ ID NO: 74434 - DNA, 836 bp, Homo sapiens
  misc_feature (51)..(51): n is a, c, g, or t
tagtcattacaacgctgtgttcacgcacaaccaccaccacaaaaaactcangaagggcagggagtctcgccatcttgcccaggctcatttcaaactcctgagcacaagcgatccttcatcttggcgtcctgaactgctgggattaaaggcacagtggctcatatctgtacgaccagctacttggaagattgaggagggagtatcccttgagtccaggagttccgatcagattgagcaatataaagagaccccgtcacaaaacaaaataaacaagaaaaaatttaatttgtatttatgggagacggggtttcaccatattgggcaggctggtctcgaactcctgacctcaagcgatccacccgccttgacctctcgaagttctgggattacaactgtgaaccactgcacccggcccataagttatttaaatgacggagaaatcctataaagagaaaattccacctcctctactgttagaggtgaagctcacataataaaggcctcaacaactcactagccactgtgcggacattctgattcgctaacctctgactactctgatcttttttacgactctcatttactaaccattttcaaagatctttgttgttagtgaatattcccggcaatgctattccgagatagcggacgctccgcatcgtggagtataggcgtcttgctactatcctcacaccttcgccatggcatttgttcggcgaacctagcactggggcttcggggctttggcactactctattctactgtctccctgcgtgacgtcctcggtcgtagcttaataccttgctctatctatactcctcatctcctccacccg

SEQ ID NO: 74435 - DNA, 965 bp, Homo sapiens
cgaagtgctgggattacaggcataagccaccgcgcccggtcaacagcatggttttatagaagaccaattaattatcattttacaattttatcagctggaaaagctaaaagaacagctagtggaggagaaggattctgagacgtcctatgctgtagatggtctattctcttctcatcctagcaaacgaggggagtctcgccatcttgcccaggctcatttcaaactcctgagcacaagcgatccttcatcttggcgtcctgaactgctgggattaaaggcacagtggctcatatctgtacgaccagctacttggaagattgaggagggagtatcccttgagtccaggagttccgatcagattgagcaatataaagagaccccgtcacaaaacaaaataaacaagaaaaaatttaatttgtatttatgggagacggggtttcaccatattgggcaggctggtctcgaactcctgacctcaagcgatccacccgccttgacctctcgaagttctgggattacaactgtgaaccactgcacccggcccataagttatttaaatgacggagaaatcctataaagagaaaattccacctcctctactgttagaggtgaagctcacataataaaggcctcaacaactcactagccactgtgcggacattctgattcgctaacctctgactactctgatcttttttacgactctcatttactaaccattttcaaagatctttgttgttagtgaatattcccggcaatgctattccgagatagcggacgctccgcatcgtggagtataggcgtcttgctactatcctcacaccttcgccatggcatttgttcggcgaacctagcactggggcttcggggctttggcactactctattctactgtctccctgcgtgacgtcctcggtcgtagcttaataccttgctctatctatactcctcatctcctccacccg

SEQ ID NO: 74436 - DNA, 1063 bp, Homo sapiens
  misc_feature (984)..(985): n is a, c, g, or t
  misc_feature (987)..(987): n is a, c, g, or t
  misc_feature (989)..(989): n is a, c, g, or t
catcactatcaggaagactaccacctagctcaaaagtagtcaaatgaaagacattgttcccattttcacctgccctctatgctctcagctttagtattaataagatttgaggttaattaatcctggaatctggaaattaaaccataaattgtgaaaatccaacagttttttatttcaagatgttgcttcatgcttgtgcatctatttgaatgtgtgggcatgcataggaatgcttgcttttagtgaagtgggcggatcattcgtaactgaggcacacttgccttttgcaactaagctctactgaattccaaagctatagaaatatccatcttgacctggaaagtctgtttctttgctagtccagaagattttttttaacatgaacaagatcctctcaagcactgtttgctttggactcctaactttgttatccgtgttgatttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattggtgtggaataaaagatgaaatgctcctgattattgtaaataccaaatgcatgcgggattgtgtaaagacaatgccaggttggactgcagaatgagccaacagcattgtttccctgtagagagcctatgaatggacgtgcagtcagggggttcnntnanagatctttcagaaaaaagtaagtctggttgaggctcggggacataaggatgaagggcatgtaaaagggaaccag

SEQ ID NO: 74437 - DNA, 1242 bp, Homo sapiens
  misc_feature (1163)..(1164): n is a, c, g, or t
  misc_feature (1166)..(1166): n is a, c, g, or t
  misc_feature (1168)..(1168): n is a, c, g, or t
catcactatcaggaagactaccacctagctcaaaagtagtcaaatgaaagacattgttcccattttcacctgccctctatgctctcagctttagtattaataagatttgaggttaattaatcctggaatctggaaattaaaccataaattgtgaaaatccaacagttttttatttcaagatgttgcttcatgcttgtgcatctatttgaatgtgtgggcatgcataggaatgcttgcttttagtgaagtgggcggatcattcgtaactgaggcacacttgccttttgcaactaagctctactgaattccaaagctatagaaatatccatcttgacctggaaagtctgtttctttgctagtccagaagattttttttaacatgaacaagatcctctcaagcactgtttgctttggactcctaactttgttatccgtgttgatttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagccctatcatccagaacgttgatacagcttaactgcctccaacattgccaaaacagaagaggataaaggatacatcccagctttcaattgcctcagttcggaagggacacacatcatttctactgaagtccattggccgggattagtcactgggactaccaccaacatatggcaaggcagcttgcttttggaaatactgtgtttaaagctttttctctggatgcaaaaaaagataagaatatcaggaaaatatatgtatctactcactctgctgtaggcagaccccctgaaactattggtgtggaataaaagatgaaatgctcctgattattgtaaataccaaatgcatgcgggattgtgtaaagacaatgccaggttggactgcagaatgagccaacagcattgtttccctgtagagagcctatgaatggacgtgcagtcagggggttcnntnanagatctttcagaaaaaagtaagtctggttgaggctcggggacataaggatgaagggcatgtaaaagggaaccag

SEQ ID NO: 74438 - DNA, 1204 bp, Homo sapiens
  misc_feature (1125)..(1126): n is a, c, g, or t
  misc_feature (1128)..(1128): n is a, c, g, or t
  misc_feature (1130)..(1130): n is a, c, g, or t
catcactatcaggaagactaccacctagctcaaaagtagtcaaatgaaagacattgttcccattttcacctgccctctatgctctcagctttagtattaataagatttgaggttaattaatcctggaatctggaaattaaaccataaattgtgaaaatccaacagttttttatttcaagatgttgcttcatgcttgtgcatctatttgaatgtgtgggcatgcataggaatgcttgcttttagtgaagtgggcggatcattcgtaactgaggcacacttgccttttgcaactaagctctactgaattccaaagctatagaaatatccatcttgacctggaaagtctgtttctttgctagtccagaagattttttttaacatgaacaagatcctctcaagcactgtttgctttggactcctaactttgttatccgtgttgatttttttacaatctgtgcatggacgaccatatcttacccaaggaaatgaaatatttccagataaaaaatatacaaatcgtgaggaactattgctggctctactgaataaaaattttgatttccaaagacctttcaacactgctggaaaagctaaaagaacagctagtggaggagaaggattctgagacgtcctatgctgtagatggtctattctcttctcatcctagcaaacgagccctatcatccagaacgttgatacagcttaactgcctccaacattgccaaaacagaagaggataaaggatacatcccagctttcaattgcctcagttcggaagggacacacatcatttctactgaagtccattggccgggattagtcactgggactaccaccaacatatggcaaggcagcttgcttttggaaatactgtgtttaaagctttttctctggatgcaaaaaaagataagaatatcaggaaaatatatgtatctactcactctgctgtaggcagaccccctgaaactattggtgtggaataaaagatgaaatgctcctgattattgtaaataccaaatgcatgcgggattgtgtaaagacaatgccaggttggactgcagaatgagccaacagcattgtttccctgtagagagcctatgaatggacgtgcagtcagggggttcnntnanagatctttcagaaaaaagtaagtctggttgaggctcggggacataaggatgaagggcatgtaaaagggaaccag

SEQ ID NO: 74439 - DNA, 899 bp, Homo sapiens
  misc_feature (820)..(821): n is a, c, g, or t
  misc_feature (823)..(823): n is a, c, g, or t
  misc_feature (825)..(825): n is a, c, g, or t
tgtcacttctccaagtagtgaatcatgttaactacttgattgcattgcattttatagatttattttctttctttctttttccttcatctagatcattcgtaactgaggcacacttgccttttgcaactaagctctactgaattccaaagctatagaaatatccatcttgacctggaaagtctgtttctttgctagtccagaagattttttttaacatgaacaagatcctctcaagcactgtttgctttggactcctaactttgttatccgtgttgatttttttacaatctgtgcatggacgaccatatcttacccaaggaaatgaaatatttccagataaaaaatatacaaatcgtgaggaactattgctggctctactgaataaaaattttgatttccaaagacctttcaacactgacctagccttacctaacaaactggaagaacttaaccagctggaaaagctaaaagaacagctagtggaggagaaggattctgagacgtcctatgctgtagatggtctattctcttctcatcctagcaaacgagcttgcttttggaaatactgtgtttaaagctttttctctggatgcaaaaaaagataagaatatcaggaaaatatatgtatctactcactctgctgtaggcagaccccctgaaactattggtgtggaataaaagatgaaatgctcctgattattgtaaataccaaatgcatgcgggattgtgtaaagacaatgccaggttggactgcagaatgagccaacagcattgtttccctgtagagagcctatgaatggacgtgcagtcagggggttcnntnanagatctttcagaaaaaagtaagtctggttgaggctcggggacataaggatgaagggcatgtaaaagggaaccag

SEQ ID NO: 74440 - DNA, 563 bp, Homo sapiens
ctggcttgagccacattgtcaaccagctacattattaagcacgttgtacagttcagctgtctttttttctgggtagcaagactttctcaatgaaggaagcaatggttgacttacattctggtgcatactccataccttacgtggacctgcaatgaatattttgacaactggctactttgagttttcactgatctaaggcacaaataaggtgattttctaaagtctcatattaaatattataaacaggattagatttcaagtctttcatttttttttttactctgtggcctaacctagtgtgaagtcttagttcacatccttgaattgatttgatttcttattattcaagaagtgaattattcactcttactctgtacatttcactggctgttaaacctttactttaaaggttttggaaattactacacattaaaaaaaagaagaagaagaaatgaagataaaacctttaaaggttttggaaattactacagatttaaaaaaagaagaagaaatgaagataaaacctttactttaaaggctttggaaattactacacatttaaa

SEQ ID NO: 74441 - DNA, 1269 bp, Homo sapiens
acgtggaggaaaagcacgcgagtttggagcgggtggagcaggaacagaggtggactggaatgtcacacgacggggcagctggaagggcaccactgagttcagtacttcaaaattgccgtgctctacctctccccagtgcacaaaaacactctccacaccaagctgctgctgctgggggatggagggatggcgtcagcgattcaagactgtttttcctacctgttcagcacttctttcagcgatatgaagttaaatccaggccaagttcccacctggtgggaagcactgtgcaggttcgtggggatgcagccctgcacagcccagactggactccttccccatggaactcacaacacacgggagaggcagagagatccaagcgcacagaaaaacacaagaagattcagccctgtcatcttgtgcaaatcctcactgtccccagaaggaagagaggcacacagcgctccccagccgctggaatccaggaagaattgaggtgctcaagacccaccacctctttgcctgcaaactctaagctcactgtcctgctcccttgctcccagaagtggcactggatggatcccatccaggtcagcccaggctgtcatttcctccccttctgtacctaatctcagcgagatgaagagtttacacctgtttctcacttgaattagggaagtctagtttgcattctcctgactggatgggcctgcattgaatctttcatctcattggtctggggatttggttctgaagaccaatgccttccagaatcttcctgtctctccccaaattctgggcggttctgtttccagcactcatccatgatgggggggtacaggaaatgagtgttgagggaaaggcatcccaccttctctctgttccatcttccagatctgacaactcactggaaagttcttctctgtgtccctgtcccccgtctggttctgaggccgctgctttccccagccttggtgccttgggttttctgctctgtgaaatgaaccaggtcccttatcctgttctcccctgaagaaaagagggtgtggggggcttggcacaggaaatggcccttgcctttcacaggctttggggtctgagggcagctctgatgccccagcatgcttttccaacccaacaactggggagacccgcttgccattttaccacccagtatctgaaattagcagccgcctaatctctctctgccatatcactcaatggtttaattgtgcagaaaaaaatgtattaaaatgcaaagcactcagt

SEQ ID NO: 74442 - DNA, 1186 bp, Homo sapiens
acgtggaggaaaagcacgcgagtttggagcgggtggagcaggaacagaggtggactggaatgtcacacgacggggcagctggaagtgcacaaaaacactctccacaccaagctgctgctgctgggggatggagggatggcgtcagcgattcaagactgtttttcctacctgttcagcacttctttcagcgatatgaagttaaatccagctcacaggtccctgagtgaagaggagccacccctgaggagttgtacccaaggagactcagccacagccagacctactgcacattttgagatcatggtcttggagcctgatgtcgtgattgggtgctttgggaaggtcctcactgtccccagaaggaagagaggcacacagcgctccccagccgctggaatccaggaagaattgaggtgctcaagacccaccacctctttgcctgcaaactctaagctcactgtcctgctcccttgctcccagaagtggcactggatggatcccatccaggtcagcccaggctgtcatttcctccccttctgtacctaatctcagcgagatgaagagtttacacctgtttctcacttgaattagggaagtctagtttgcattctcctgactggatgggcctgcattgaatctttcatctcattggtctggggatttggttctgaagaccaatgccttccagaatcttcctgtctctccccaaattctgggcggttctgtttccagcactcatccatgatgggggggtacaggaaatgagtgttgagggaaaggcatcccaccttctctctgttccatcttccagatctgacaactcactggaaagttcttctctgtgtccctgtcccccgtctggttctgaggccgctgctttccccagccttggtgccttgggttttctgctctgtgaaatgaaccaggtcccttatcctgttctcccctgaagaaaagagggtgtggggggcttggcacaggaaatggcccttgcctttcacaggctttggggtctgagggcagctctgatgccccagcatgcttttccaacccaacaactggggagacccgcttgccattttaccacccagtatctgaaattagcagccgcctaatctctctctgccatatcactcaatggtttaattgtgcagaaaaaaatgtattaaaatgcaaagcactcagt

SEQ ID NO: 74443 - DNA, 669 bp, Homo sapiens
acgtggaggaaaagcacgcgagtttggagcgggtggagcaggaacagaggtggactggaatgtcacacgacggggcagctggaagggcaccactgagttcagtacttcaaaattgccgtgctctacctctccccagtgcacaaaaacactctccacaccaagctgctgctgctgggggatggagggatggcgtcagcgattcaagactgtttttcctacctgttcagcacttctttcagcgatatgaagttaaatccaggccaagttcccacctggtgggaagcactgtgcaggttcgtggggatgcagccctgcacagcccagactggactccttccccatggaactcacaacacacgggagaggcagagagatccaagcgcacagaaaaacacaagaagattcagccctgtcatcttgtgcaaaagtcacacaggctggagtgcagtggcatgatctcagctccccacaacctctgcctccgatgttcaagcgattctcctgtctcagcctgctgagtagctggaattacagggcatgctttctcgcctgccggccttccaccatgggatgaagcagcaagaaggctcttgccagaggcagacccctcgaccttggacttcccagcccccagaactgtgagaaataaatctctcttctttatatatt

SEQ ID NO: 74444 - DNA, 585 bp, Homo sapiens
acgtggaggaaaagcacgcgagtttggagcgggtggagcaggaacagaggtggactggaatgtcacacgacggggcagctggaagggcaccactgagttcagtacttcaaaattgccgtgctctacctctccccagtgcacaaaaacactctccacaccaagctgctgctgctgggggatggagggatggcgtcagcgattcaagactgtttttcctacctgttcagcacttctttcagcgatatgaagttaaatccagatgtcgtcatcatccacttgttcaaacaagagcccaaggatcatcctagattccttctcacttcctctcaatccatccctgaaacagccaaaccaccagccaagttcccacctggtgggaagcactgtgcaggttcgtggggatgcagccctgcacagcccagactggactccttccccatggaactcacaacacacgggagaggcagagagatccaagcgcacagaaaaacacaagaagattcagccctgtcatcttgtgcaaagtgagttccacataattcaattataaaatgagagattgtgtttctgtgagcttcataaaaa

SEQ ID NO: 74445 - DNA, 537 bp, Homo sapiens
acgtggaggaaaagcacgcgagtttggagcgggtggagcaggaacagaggtggactggaatgtcacacgacggggcagctggaagggcaccactgagttcagtacttcaaaattgccgtgctctacctctccccagtgcacaaaaacactctccacaccaagctgctgctgctgggggatggagggatggcgtcagcgattcaagactgtttttcctacctgttcagcacttctttcagcgatatgaagttaaatccaggcatcatcgccatcaacatacagccatactccaggattgcccatcttcaacataaacggactctcctggactccacttcccacatcagtcacagccacacttcctgagaaagaagtctacactcttcattcactttcattcacccacttccaacctggctcctgttaccactggaccgtcaaaagtgactcttgtcaaagtcactattctggctacctattgctgtgtaataacctcctcaaaatttagtatctttaaaaaacaatttattatgtctc

SEQ ID NO: 74446 - DNA, 776 bp, Homo sapiens
acgtggaggaaaagcacgcgagtttggagcgggtggagcaggaacagaggtggactggaatgtcacacgacggggcagctggaagggcaccactgagttcagtacttcaaaattgccgtgctctacctctccccagtgcacaaaaacactctccacaccaagctgctgctgctgggggatggagggatggcgtcagcgattcaagactgtttttcctacctgttcagcacttctttcagcgatatgaagttaaatccaggccaagttcccacctggtgggaagcactgtgcaggttcgtggggatgcagccctgcacagcccagactggactccttccccatggaactcacaacacacgggagaggcagagagatccaagcgcacagaaaaacacaagaagattcagccctgtcatcttgtgcaaagatgagtcaggaactcctggagtgagaagggctcaggcctcacccagcagtgacctcagagagggtgtgcaaggtcagaagagcctccagctgagctcagcactgtgacaacagactttccaaaatacgcttaagggtctggccggggctggacatgctccagcaggtgtcagggaagaagaatgagcaagctggctgagtctgagcctggccccgcctaatgttgtctcctccctgaagcctcccctcccttctgtgctaccacagttcttaggtctgtggcgtcctgaagccactggtgccatgtgatggtttgcatttcaattaattaaaattacatgaaatgaaag

SEQ ID NO: 74447 - DNA, 444 bp, Homo sapiens
acgtggaggaaaagcacgcgagtttggagcgggtggagcaggaacagaggtggactggaatgtcacacgacggggcagctggaagggcaccactgagttcagtacttcaaaattgccgtgctctacctctccccagtgcacaaaaacactctccacaccaagctgctgctgctgggggatggagggatggcgtcagcgattcaagactgtttttcctacctgttcagcacttctttcagcgatatgaagttaaatccagatgtcgtcatcatccacttgttcaaacaagagcccaaggatcatcctagattccttctcacttcctctcaatccatccctgaaacagccaaaccaccaagcagcaagagggatcttataaaaatatgaccagatcacatccttcaacacttccctgttacccttacaataaaattcaaactcttc

SEQ ID NO: 74448 - DNA, 325 bp, Homo sapiens
ccctatgtgttggtttgtaatatagtctgcttgcttcttatcttactaagacaaatcccaacatagcccacagctactgaccacaataaaacataatggtcaatatgagagtcatgcaaacaagctctccctttcttgttgcattttctagtgactaacagtgttttcttcaaagtagccaatccgcaatctcagcaggaatgcctaagggataacactcatagaccttactatagccatagactcacaggtgatctctcttttgctctttctcttctattcactccctcctcattcctcacctgctggttgagcatcctgctgt

SEQ ID NO: 74449 - DNA, 423 bp, Homo sapiens
tgagtcaaaacgatcttgacgggaagctgttagaggtctcatggaaataggcctggagcacaggatttggctgaggctttcaactgacatcagacaagactgcaatcaagggaaagcagacctggggaccacgggcaatcacatgagatgagaaataccaaagaatgtgaccatccaggtagccgggggacacagctccaaaaaagtgagagtggtgctggattagctccattggaggaactggaggttccattgccatttggcaaaccagatcctcctccatgatggcggtcagctgacagtgaccaacagcccccgactacacaaagagaatgactgcagacaagaactgagaagaaaaactggagctggtataggtgaactcaggctgggaataaactgatgttatctcaaaagtccact

SEQ ID NO: 74450 - DNA, 249 bp, Homo sapiens
acagcttttatttttatttttttttaaattttctctggaatagtcttcattttgtcataatattcccacactgaaggttaggagaggggagattaagaaaggaacagagccaaaggtaattaaacattctattaatatttaaaatgttgcaatcacaagcatctgactgttagtagtcctgttatcacattcatatcccataggctcaattctactgtcaatgtgctgatatcacgctcatgaagctgc

SEQ ID NO: 74451 - DNA, 368 bp, Homo sapiens
atgtcctccagaattgttcttcctcctccatagatcctcgcagcttctcctctccatcattttaactgcacagtgcactctctatccctgggactccccccatccaaagcccccacagcccgtttcctagtctaagtgactttccctcctgctctagaactttttctaacctcaaaccctgggaggcccctcaagtcatcagccctaaaactttcatctcaaaataacttacaattctttctaccttgccctgggattccttccacctgccctcttcctttctcgaacctccccccccgccgtgcaaaacccagaacctagcccctcagtctgtccccctccatcaaagtgaaccaaagagccttctc

SEQ ID NO: 74452 - DNA, 471 bp, Homo sapiens
  misc_feature (222)..(222): n is a, c, g, or t
tatgcttctctgcgtatatgcccagctctcagggtgtatggggctggagaatgcatgcgtagactgtgtgtatatgtaaactagaaactgaaccagggaaacaaaatgaactactgtatgcaagaaatatatgaagtgcacccagctgccggcagcaattgctacatgcagtccactgattattacgcgtattttgaagatagtccgggttacagcggttgngatgctcaggctgtgcccagtaacaacatatatatggaacaggcctgggcagtgaatcagccttatacctgtagttaccctggaaacatgtttaaaagcaaggactctgacttggacatggccctgaatcaatacagccaacctgaatatttcactgaagaaaagcctactttttctcaagtgcagtcgccatcgtattctcaaaaaaaagggtacatccccagttacttagacaaggacgagctctgt

SEQ ID NO: 74453 - DNA, 275 bp, Homo sapiens
cccccccccccacctacaccctcatctaccacaaaacttccccaaggactttcttttgccaagcgcctacagcagctcatagaggtcttgaaggggaagacctattccgacggaaagaaccattatgacatggagaccacagagctcccagaactgacctcgacctcctgatctgacctggttctcaacagacccagtgagcccttcactcctgagaaaaaggaaagatgaaataaataaataaacatatatatatagatatacacacacacata

SEQ ID NO: 74454 - DNA, 421 bp, Homo sapiens
tgagatggagtcttactctgtcacccaggctggagtgcagtggcatgatatcagctcactgcaacctccgcctcctgggttcaagcgattctcctgcctcagcctcccgagtagctgggattccaggtacccgccaccacacccggcggctaatttttgtatatttagtagagacagggtttcaccacttgggccaggctagtcttgaactcctgacctcgtgatccacccgcctcagcctcccaaagtgctgggattataggcgtgaaccaccgcgcctggacagatctctatgatcttaagttaggcaaagatttcatagctacaacacaaaaggcaaagccataaaagagaaaattcataagtggaacttatcaaaattaaaaacttttaacttcaaaagaaagtcgagtgaaacact

SEQ ID NO: 74455 - DNA, 198 bp, Homo sapiens
gagttggagttaacaatataagctcagtttttaatatataggagtatagacagatataaaggtgtttgtgtaaatgtgcactcacatacatatatttcctagctctgtctgctgagaaggcctagaagcaatgatacccctatagctatgaacacagctggtgctctgataaaaggaactagggttccttgaagaaat

SEQ ID NO: 74456 - DNA, 756 bp, Homo sapiens
cgccccgccgcccgccgcctcctggggccgctctccactgcgagtccgccgggactaaccgggcgtttgcgagagggggtgcgtccaagggcccctcccgcgtgtccggcgcccacctttggccctgagggccgagtggggagccccacgacgctattacagcctttcagatgcacggactgggaaactggggctcagagaagtcaagtggctcgcccaaggtcacccagcgagtgatcctgggaagaggggacaagggccgagctggagctgggaagggcgccccagttcgccccagtcgcgctctgaggaatagcagcgggaccgccctgctctctaaagcttcctggacttctctaagttatgtcgcgttgctgtcccctcgtacttataagagagtaaggcaggggcgccgtcctttctccgcgcctgagctcagagcgccaacctcctgagatccgccagctcagagccagctcaagtcccggcctcaatgtcaccttccctggacagcctctcaggacctccctggcaaatctcaacttgcaagaagcagaaaaatggcacagttaaaagcaaagcctctggggttaaacagcctggatttggaatcatggatctgctgctcactagctgtgaccttgggcaagtttcttcacctcagggtcctcatccgtcaagtggagatgacaaccaaacttatttcataagaagttcatgagaataaatatgttaactcataatgaaatacccaaa

SEQ ID NO: 74457 - DNA, 573 bp, Homo sapiens
gggacagagtttgagttttgtttttgagggggaaggtcaccagtgtgtagtacagggggcagggatggagggtactggaaatgtctcttggaggaataagtcagtggcataccactctcagccaatagcctgaggacaatcgccacagtcccccaggcagcccccccgcactcccaatgcaaatggaggcagctttacaaacccgaggggagtgggaggtggtagaaatcttggaagctctaagtcccagacccgagtactcaactgccctcactctcaaggctccactcctcccccggctaaggtgtcatttcagagtccccagtaagagtcttcttcatggctctcttcagtctcaacttgcaagaagcagaaaaatggcacagttaaaagcaaagcctctggggttaaacagcctggatttggaatcatggatctgctgctcactagctgtgaccttgggcaagtttcttcacctcagggtcctcatccgtcaagtggagatgacaaccaaacttatttcataagaagttcatgagaataaatatgttaactcataatgaaatacccaaa

SEQ ID NO: 74458 - DNA, 257 bp, Homo sapiens
ggaaaaaacatccatttattgtccactgtgcccaggtccatgctaggcactatagaagatacaagggaaggcccttgccctggaaatgtttattctctatctggaaaaaagattaactcacataaaataattaaaaataagatgccagcctctaaggaaaaatgttagattgtctgaaactcaagcagagagcattttggctgccctggaattccccatagtagtagaattactcttggggccaagagaggggttgc

SEQ ID NO: 74459 - DNA, 286 bp, Homo sapiens
ctcttccaaggatcagcctgagatgtaaacgaaaggtctttgctcagtctgcatcttttcctgggcatgcgcagtcactttctgattttccctctatatgcagttgcttttgaatgtcctagtctatttatttatttagagacaagagtctctgtcacacaggctagagtgcagtggcacagtctcagctcagtgcaacctccgcctcctgggtttaagtgattctcctgcctcagcctcccatgtagctgggattacaggtgcatgccaccacacctggctaatt

SEQ ID NO: 74460 - DNA, 437 bp, Homo sapiens
acttaataacaaatattttgctgtaagttgatttattatattggatcagtactgcttgtttttcagtgatttcctcacttggacataatacaaatcagtgttcttgttgtttgttatacatttagacatttacatcagtttaaaagttagtcttcaacaaatatttgtgtccacactttagtattccattgtttgaaagattcaggctttgtccactctggtttatagttacatatgcttaaaattttttcactttgtggaaatgtctgtaaaatacatttttgtaacatgaatcatttctactgataaccataaatttgcccttcctgctttgcactgattgcggcacaaggaagagaaagagaaggaagcaccagctttgggaacataggccttaagcttgaagcagagagaatgaaagcagactgtattagatt

SEQ ID NO: 74461 - DNA, 401 bp, Homo sapiens
acctgccgccccagccgccgctgtacactggcgcttagcgctcagccgacccgagggcgccgggctgggcgggcggagtcgggccgtgggggcggggccgcgaggaaggcttgcctagcccaggccctccgcccatccgactcttccggcccttggaggcctggctcctgtaccttcacctggcgtcttggcgcctttttctcagcggcctgtgggtggatgtgcatggtgtggcctggagagagcctggagctccatgagcacctgaagactgaaagaggaaatggaagtgggggcggccacacccagtgcagggttgatactgtgccctgaggtgacataaaagacactccttttccaaagcagaattggccaggaaatgaataaacacccggagaaaa

SEQ ID NO: 74462 - DNA, 424 bp, Homo sapiens
acctgccgccccagccgccgctgtacactggcgcttagcgctcagccgacccgagggcgccgggctgggcgggcggagtcgggccgtgggggcggggccgcgaggaaggcttgcctagcccaggccctccgcccatccgactcttccggcccttggaggcctggctcctgtaccttcacctggcgtcttggcgcctttttctcagcggcctgtgggtggatgtgcatggtgtggcctggagagagtgcaggactccccctccttccagcctggagctccatgagcacctgaagactgaaagaggaaatggaagtgggggcggccacacccagtgcagggttgatactgtgccctgaggtgacataaaagacactccttttccaaagcagaattggccaggaaatgaataaacacccggagaaaa

SEQ ID NO: 74463 - DNA, 320 bp, Homo sapiens
ttagccaggatggtctcgatctcctgacctcatgatctgcccgccttggcctcccaaagtgctgggattacaggcatgagccactgcgcctggctggtgataactttttagatccaataccaaaattatagttcatgaaagaaacaattgataagctgaacttcaacaaaattaaaacttctgctctgcaaaagacaacgtcaagagaatgagaagagaagccacagactgggagaaaatatttgcaaaagaaccatctgacaaaggactcttatccaaaatacacaaagaaatcttaaaattcaacaataagaaaatga

SEQ ID NO: 74464 - DNA, 552 bp, Homo sapiens
gataattggctcttcactcctctgccttcccagtacacaggtattgctaaagtggttaggctttaatgttttatgtttttagtttcaaactatgggaaatggagatttgaagaggcatttattccttgtcatcattttgtgtgctctgtgagaaggtggttatatgtttttgctggtttgtgtcccacagtgttcaactgcacattattctgatgaaaatccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgca

SEQ ID NO: 74465 - DNA, 447 bp, Homo sapiens
caagaagccccaggtattcctaatcccaattgtttaagtctttccagtgttaaccaccagacatgtgatggattaaggactccagattattccagttcccagctgtcttagtcagggttctccggagaagttatcacatgattacagaggctggcaagtctgacgtctgcagggtagaccagcaagtcagagacccatggaagttgatgttgcagctcaagtccaaaggcaatctgctggcagaatcctctcttctgtttcctcagtgtgtttttacttaagaaactgattggatgagccccacccacattatggagggaaattgccagtgctctggatgcaaatggatttttccttaggaattcagagttgctgagttttgcatcaagactgaaagaggccaaaaagagaagctgtgtggtaggactgtgtgatgactcatcctac

SEQ ID NO: 74466 - DNA, 568 bp, Homo sapiens
caagaagccccaggtattcctaatcccaattgtttaagtctttccagtgttaaccaccagacatgtgatggattaaggactccagattattccagttcccagctgtcttagtcagggttctccggagaagttatcacatgattacagaggctggcaagtctgacgtctgcagggtagaccagcaagtcagagacccatggaagttgatgttgcagctcaagtccaaaggcaatctgctggcagaatcctctcttctgtttcctcagtgtgtttttacttaagaaactgattggatgagccccacccacattatggagggtaatttactttacttaaagtttacttatttaaatgttaatctcgtttaaaaaataccttcaaagcaacatccacactggtgtttaaccaagtatctgggtcctatgaccttgctaaattgacacataaaattaaccattacaccaaccattaagctaccccagctaacaccaactggaacagcaacaagccgctccaccaagtacgcccaaattgtagaattgtgagcataataaatattgttatttta

SEQ ID NO: 74467 - DNA, 333 bp, Homo sapiens
agagatgggggtctcattatgttgcccaggctggtctcgaactcctgggctcaagctatccacctaccttggcctcccaaaatgctgggatcacaggtgcaagccaccgtacctggccttatgtactactttgaactttttctcaatccagaacttcagaaagtgttatttcaaagactaacaaagctagaatggcagtcacatagagtatggaactgctcactcttttgacaagaggtaatttcccctcctgtctcctgcaagggcctctcactgcaccagtctcaaggtcctcagcatggaattcaaatgctaatctgtaccatagagctt

SEQ ID NO: 74468 - DNA, 3139 bp, Homo sapiens
  misc_feature (3093)..(3093): n is a, c, g, or t
ggctggatcccaccactgtccaggttcccaattgatattttcttcacaccaaagcaggaaggagatgtgaactttaatttgatctgcaatgtggaaaagaaagtccaccctgtgacattaaatgtcaaggccgagggctacactatgaatgtggagatcaagtgcaaggacaggacaggctccatcactctgttgactcccaaccagactaacatcatcaacttctatgaggtggagttaaatgaatgtgtccagtgtgaattcaactttatcaacactggaaagttcaccttcagcttccaggcacagctgtgtggctccaaaaccttgctgcagtacttggaattttcacccatcgacagcactgtggatgtaggacagagtgtacatgccaccctgtcttttcaaccattaaagaagtgtgtcttgacagacctggaactcataatcaagatcagccatggtccaacatttatgtgcaacatctcaggctgtgctgtgagcccggctatccatttctccttcaccagctacaactttgggacctgctttatctatcaagctgggatgcccccatacaaacaaaccctggtaattaccaacaaggaagaaacacctatgagcatagattgtctgtacaccaacaccactcacctcgaggtgaactcccgtgttgatgtggtaaagccaggaaacacattggagattccaataactttttatcctcgagaaagtatcaactatcaagaactcattccctttgaaatcaatgggctctcacaacaaacagtcgaaatcaaagggaagggtaccaaaatgaagattttagtcctagatccagccaacaggattgtgaagttgggagctgtcctaccagggcaggttgtgaaaagaacagtttccatcatgaacaacagcctggcccagctcacatttaatcagtccattctgttcacaattccagaactccaggaacccaaggtccttaccctggcgcccttccacaacatcacactgaagcccaaagaagtctgtaaactggaagtcatctttgccccgaagaagcgtgtccctcccttctctgaggaagtgttcatggaatgcatggggctcctgcgccccctcttcctccttagcggctgctgccaggccctggagatctcactggaccaggaacatattccctttggacccgtggtgtatcagacgcaagccacacgtcgcatcctcatgatgaacacaggcgatgtgggtgcaaggtttaaatgggacatcaaaaaatttgagcctcatttctccattagcccagaagaaggctatattacctcaggcatggaggtttcttttgaagtgacctaccatcccaccgaggtgggaaaggagagcctttgtaaaaacattctctgctacatccagggaggcagtcctctgagtctaaccctgtctggagtctgcgtgggaccacctgcggtaaaagaggtagtgaatttcacgtgccaggtgcgctccaagcacacgcagaccatcctgctgtcaaaccgcaccaaccagacctggaatctgcaccccatctttgagggcgagcactgggaggggcctgagttcatcaccctggaggcccaccagcaaaacaagccctatgagatcacctacaggccccgcaccatgaacttggagaaccgcaagcaccagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagagattccgggtcatcgtggaaatactgaaaccagagaagccggacctaagcatcactatgaagggccttgattacattgatgtactgtctggctctaagaaagactacaagctgaacttcttttcccacaaggagggaacgtacgctgcaaaggtgatcttccgaaacgaggtgacaaatgagttcttgtactacaatgtgagtttcagggtcatcccttcaggcatcatcaaaaccatcgagatggtgaccccagtccggcaagttgcgtcagcctccatcaagttggagaaccctctgccctactcggtgaccttctccacggaatgccggatgcccgacatcgccctgccctcccagtttgtggtgcctgccaactccgagggcacgttctcatttgaatttcagcccctgaaagctggagaaaccttcggaagactaactttgcacaacactgacttgggttactaccaatatgagctctatctgaaagccacgccagcacttccggaaaagcctgttcacttccagactgtccttggcagcagccaaatcatccttgtgaagttcatcaattacacacggcagaggacagaatactactgcaggaccgactgtacagacttccacgcagaaaaactcattaatgcagccccaggaggccagggaggcactgaagccagtgtggaagtcttattcgagcccagccacctgggtgagaccaagggcatcctgatcctatcatcgctcgcaggtggagagtatatcatccccctctttggaatggctctgcctcccaagccccaaggtcccttctcgatccgagccgggtacagcataatcatccccttcaagaatgtcttctatcacatggtgaccttctccatcatcgtggataacccagccttcaccattcgcgctggagagtctgtgcggcccaagaagatcaacaacatcacagtctcctttgaaggaaacccatctggcagcaaaacccccatcaccaccaagctgactgtgagctgccctcctggtgaagggagtgagactggagttaaatgggtttattatctgaaggggatcaccctttagtggtaaccagggttacctgtatcaaccaaaagctatgcattgtcttagcctgaaaaagaatagagaaaacaataagaattctaaaggaactgtttttattcttctcatacaattatagggcagttatttccctattatgtgttttcnaaatatagatatgaaatatctattccatattaaacattataactac

SEQ ID NO: 74469 - DNA, 356 bp, Homo sapiens
tattatgtttctttccagagcctccattatcctccattaatcctgggtctctacatgtccaataagtacctagtaaagaatgctgtgtggcattctgatcacatccttcttctccttagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagaggtaagggggtggggctagggggctgggtggggagatgaaaggaggactttcaccatctagcctggtccttccc

SEQ ID NO: 74470 - DNA, 618 bp, Homo sapiens
tacatgcagggtctaggtgggaccaacagtggctccagatgtatatacacacgggtccaggggcaacagaacaggccaggctacagtatggacttgaacctctgcttcacttctggtctctgttttacagtagtgctcaccaatatttcaataaattctactgaacttactctaatagaacattattcaacccccaaagacttatctcttcactatgacatctccatactttatttttaggagacagactttcaaaaccagagaaatcaggtgccttcctcaaggtcatgctccaacccaggccaactattaaatgcttgcatctgttagctggattagtctctatgtatactgaactgtgatgaaaatctatagctttgttttagaaaattattgttgatggactattaatattatattaacaatttctcagtaagtgtgttttttcctcattgaatctaggaatgctgggctttaagttgataactgtgtcatttcaatcaagtacaaggattttgaggcagattttgctagatatcttagtaatcccccacaatgttttatgtaactcttctcagaatatcaatacattaattattttagatgacatattaaata

SEQ ID NO: 74471 - DNA, 394 bp, Homo sapiens
ccagtctgggagcttcaataccctgtcttttaaaaactgaaagataaagttgtttattattttacatgaatcagtatttactacttctgcatgggggcatttctggtaaagactggaaaacctgctagacaaattctgtaagagctgcaacactccagtacttcttttctcttttgtagagatggggtcgcactatattgcccaagctggtctccagctcctgaactcaagtgatcctcctacctcagcctcccaaagtgctgggattacaggcataagacaccatgcctagcctccagtacttctaaaataaactgctggatagcattaaattattttcatgaagttttatgtacatataagaaatgtcatgaatgtccccatattctccttt

SEQ ID NO: 74472 - DNA, 351 bp, Homo sapiens
actaacaatatattttgcaccgaacatgttattcaggtctaagtcatctcatagaccatcttacatgactatttttgcagcagaaatcacaatttcaatatttgggtggcacccattttgctttgattcacactatttcctcagagctagtcagcaaatagtcaaatgaccttccagtgactgcacaaaatatggaatgcttcaaagatctgtgctgcctccttatgcagaagccacgctaactttccccgtattgttccaattttaggatatgtgccgccgaagcaagcacaaagccctacttttacacatgattagtgatgcgtcatggacaaggcttggctctgtgaa

SEQ ID NO: 74473 - DNA, 549 bp, Homo sapiens
ttttgggaaaggaaatgaggctaatctgtagtcataaaattctgatactttgcggaaattagaagatggtgatagtgcattcttttgtgcccaccccccctctgatggatgttgttagcccaaattacatttttcatatcatggacattgaatagggtttattgaatcaggaaggtaaggggaagaaccgggcacatatgtgttggaatactgtgggtttgacacctggttgaaaacaacttattggacatgatttttaacccaggatattttttttcccaaagcagatctaaattgtttactacccagggttggaaagggcaggcacctctaatctagtctttgtcctctggttgccctctcccacacccctttccacctatacttggttcaagacattttctgaaacgaaaattctgctgttgttcaaactgccattggttatgagaactctgcgtcctttgggatcatctcttagaactccagtgatctatcatatttgctgctacatttgtaaaatgaactttgcctgtattggttgactttaat

SEQ ID NO: 74474 - DNA, 389 bp, Homo sapiens
ttcaaaaccagaaaaatctgtcaacacagcaattataatagtaacatcttaaagaggaaaatcatatggcatttgaccaaattcagcagcagtacccacccagcatgcactggcatggcgccaaccagcctgcatgggtccgggaagagtcctgtgagcttggactccggagcaccagcggccttgcaaaggctgcttaccagaaaccaagagccactttcccatcaacttaggaaacgctgaagccatttactgaaatgggagaaaacaggaatgcctgctatcacctctgttccaggttttattggtccttcttagtggcagaataaaattaaaataactagtctatgttggcataaatagtggaagagagataaaagaatctattg

SEQ ID NO: 74475 - DNA, 313 bp, Homo sapiens
agattctcttaactgagaagtttttatctccttttcctttttactcttgtgtctgctgaggtaggaaattgtagtgagtcctctatttatcctataggtgagtcatttttgtttttttgggactttgaacagaggcagaggcttcagtgacgataaaggaaacagtgtgtggttgtgttttttcatggaaatttttctggggcttgctccatagagcagggctttcccataggcagagaggcccagagtagcacacacatgtgtgtgtgtgttctaagcaacataatatggatttggacagagagggaaagtg

SEQ ID NO: 74476 - DNA, 466 bp, Homo sapiens
agctttgcatgtgacattttttcagcccctcatgcccacatctacactcaaggattccacccccataccatgtagctacattaaactcaacatattccagactggatttctgtctgcacctctatctaccatgccaatctgtgcttcctctgtttcctccctcaaggaacagaaacctgatatttagccaccgatggccccagaaggtccaacaggaggagctccaggacctgtctaggaggggagatgtggacacttcctgtaaagtggggcatgcatgaggaggaggtggcctggatccttccctttctgggtaaagggtggaagcggtgtggattctttacttcgtgtgttctgatagccatgtgtcactgtgtacttgttctttgggtcttcacatctcctcctgttgcattttaaagcatttcaatggcatttttatgcctaataaagcattctcctagaa

SEQ ID NO: 74477 - DNA, 665 bp, Homo sapiens
ctgtgtatgtattcctcatactatacttgtataatgcacataggtgccatatatgaatgcatgccattttgttaacttattttcttctgtcatagacaaacaaaattcaaagcaataatgacaaaaaccagtgtttcatttcctcctcaaatgtgtaaaatcactcgttatgctgcctagtagaggggaagagtacgaagaggccactaggttagcaagggcatggagtgatttcaagagaagatataaagttttcttgctcattttatagttatcaaaactttttctgccagtgagccctgaattttttgtacacaatctcttgtgtgattacattagcatttctacaggtctgaaaatatagcaaaaactgaagtaattgttggtcattggctgaggctcaaaaactactaattttgctaattctcaattttgctaattcagaaaccaagtaaacaaaaatatcttcaacgactgttgtcagtagttgaagccaaattactgaccttccaaggccacccagaattatcaccatgattttctggatcataatattcatctgatgttatagaccaatggttgccaaactatatggcctgtgggcttaatcttagcttgtacattctgcaagctaagaatgatatttacctttttaaatgcctgaa

SEQ ID NO: 74478 - DNA, 807 bp, Homo sapiens
tctctggtctctgctagtatatttttcacctctatttaatggaatttcaacttggttctttggcataatttccatgactctacagaaatccccatcttttcaagcatattgttaacctttatcattcaatcatccagcatttttttcataattatctttaaatccctgtctgataattctgataaatctggatcatctctgggtcttcttctactgactatttcttctcttgacctttggtcacattttcttgcttttcttgtgtcttgtaactttttattacacaccagacattttatataaaaatagattacttattaaattaagtaatattttacttccagaaaaagacacgacaatttttctgttaggacactagaagggagtctgagtcaatccaatatgtaactgagctgggtgtgggctatgatgcagctgtaatttgacagttaatcactggcttcaaatatttaaggactgagatcaagtccttcacttgagcaggtctgggatctgagcctaggtaaaattacagagacctgcttgtgtttcatagccaagccaccaatttttaaaactgtgggagtaccttacatgtatgctagagtagaatgattaagtaaatgggtggctgatggtaggagacagatttctcactattggagcaggagtttttagataagcaagggcaggaagttagaatcatccatgtagtgattcaactggaaccgaatacatcaatataaactcatgtttagcttaattagatacagatggatacatatagaaatatttatagatatgtgg

SEQ ID NO: 74479 - DNA, 482 bp, Homo sapiens
tgatgaatgaacatgcacaaaatatttatagcaaatatatttgctggtaagatgaatgctttccctgtaaaactgggaacaaggcaaggatgtttgctcctgccactcttattcattgtagtactgtaacttctatcaagcacaatgaggcaagaaagtgaaatagaagtcatacacgtagagaagaaataaaactttatatttacatatgacatgattgtatacgtagaatattacaaggaatcttagaaaaaaacctcaggccaggcgcagtggctcatgcctataatcccagcgctttgggaggctgaggcaggtggatcacctgagatcgggagttcaagagcagcctgaccaatatggagaaaccccatctctactaaaaatacaaaattagccgggtgtggtggtgcatgcctgtaatcccagctacgtgggaggcaggagaattgcttcaacctggaaggtggaggttacggtga

SEQ ID NO: 74480 - DNA, 344 bp, Homo sapiens
tgatgaatgaacatgcacaaaatatttatagcaaatatatttgctggtaagatgaatgctttccctgtaaaactgggaacaaggcaaggatgtttgctcctgccactcttattcattgtagtactgtaacttctatcaagcacaatgaggcaagaaagtgaaatagaagtcatacacgtagagaagaaataaaactttatatttacatatgacatgattgtatacgtagaatattacaaggaatcttagaaaaaaacctcaggccaggctggtctcaaactcctgacctcgtgatctgcccgccttggcctcccaaagtgctgggattacaggtttgagccacc

SEQ ID NO: 74481 - DNA, 665 bp, Homo sapiens
aaatgatattaaatctcactgtggagcatcataaaaacaacctatttgtcagagaagagtaggacaattgtcctattaaattggaaaactgaaaaagaaaatttaaaaacagacttccattattgcattcatatgacaaatactttttgagtgtctgtgtcactgggcactgtactaccttgtaactacctaggcagtcggggtagggaatcctccttggggaagtaccctttgtaaggccaggcacagagaaaaaggagggtaaagagtgtgctaggtaataggtagaggacatgtacaaatagatggctactgattttcagttgataactatgtctaattaggtgaataccatcttattctagcaagagtatcagagtgcgttcattcctgaggaccctttccctggtgttgaaacaaattatctctagccttcagtacgaaataaattcccttttgctacatttctgccaaatctgaagaatcacaatggatgagtctcatgcctatttcaaaatggtatagagtctctgggggttcagtatatttaacttgtttcctcataagtgtgacttcaagatattgtttcatgctggaattgtaaattgtgatttatccattctctgtagaaatattaaataaatctgaaaaaactccaaaaccca

SEQ ID NO: 74482 - DNA, 400 bp, Homo sapiens
ttgccctctcggcctagaagtctcccattatggtgctgtgtctgctgggacccacggggcgctgcacagggaaccatgtggccgtgaacctcaagtccagcccagcaggggtcaattgtctcagcccacccctccctacccccagtatcctctctcctttatagatcatccattaagtgccagacactgcagaaggcacattgactaatattaaatattagcccagctaccctgctgggctgtccttcttagaaatgaggaagtggagggttaagtggatttctcaaggtcgtgcagctggtaaatggcagaaccaggatttgaactcaggtgtgcatgacttcaaaggaagacaccactgaggcctcctctactgggtctgcctccctaccgcccctgg

SEQ ID NO: 74483 - DNA, 459 bp, Homo sapiens
taggtgccttaatgtttgtggcatggatgactactgttagcataggtgtactggttgcccggttcttcaagccagtttggtcaaaagctttcttgcttggtgaagcagcttggtttcaggtgcatcggatgctcatgttcaccacaactgtcctcacctgcattgcttttgttatgccgtttatatacaggggaggctggagtaggcatgcaggttaccacccatacctcggctgtatagtgatgactttggcagttcttcagcctcttctggcagtcttcaggccacctttacatgacccaagaaggcaaatgtttaactggactcattggagtatgggaacagctgctagaataatagcagtggcagcgatgttcctgggaatggatttaccaggactgaatcttcctgattcatggaaaacctatgcaatgaccggattcgtagcctggcatgttg

SEQ ID NO: 74484 - DNA, 637 bp, Homo sapiens
taggtgccttaatgtttgtggcatggatgactactgttagcataggtgtactggttgcccggttcttcaagccagtttggtcaaaagctttcttgcttggtgaagcagcttggtttcaggtgcatcggatgctcatgttcaccacaactgtcctcacctgcattgcttttgttatgccgtttatatacaggggaggctggagtaggcatgcaggttaccacccatacctcggctgtatagtgatgactttggcagttcttcagcctcttctggcagtcttcaggccacctttacatgacccaagaaggcaaatgtttaactggactcattggagtatgggaacagctgctagaataatagcagacttaatacaatctggaaaatgtgggtgcatctcttttaaggattggtagattacgcagccataaaaaagaatgaagtcatgtcttttgtagcaacatggatgctgctggaagtgattatcctacatgaattaatgcagaaacagaaaatcacataccacatgttctcacttataaattggcagcgatgttcctgggaatggatttaccaggactgaatcttcctgattcatggaaaacctatgcaatgaccggattcgtagcctggcatgttg

SEQ ID NO: 74485 - DNA, 419 bp, Homo sapiens
tataacagagagactggatggcctttgtcccagctccagttggtgccctttaaatccctgaaatgtcctgagagggacagggcatctctgtgattcatggtgagcacctagtttatgttaacaagatctcaggatgtggaggtggggggctggccaaaccagaaagaccaaccatggcattagaaggttggggctctgagccccaggataacagcccaaagttcagagaggggagcaagaaattgagttcaagctcaaggccaatgattcaatggatcatgctgatgtagttaagcaccaataaaaactctggacacagaggctcacatgagctttcccggttaataccctgtctccacaggagggcatgaacacttcatatctgagaccttcccagacactgccctatatgtcacttc

SEQ ID NO: 74486 - DNA, 222 bp, Homo sapiens
agggttttagaaaacttttgagaatccaagtatagtttgagtagggagtgtgatacataggtttagagtttcaagaaaggtgagcatttgttaagtatctacacatatattactgtcaaagccgtaattatctatgagattatttaaggggattatatattctgaaagaattttcaaataatgtggaaatgctcatgaaataatgagacgaaattcaggaaa

SEQ ID NO: 74487 - DNA, 427 bp, Homo sapiens
cataaatgtactatggaaaataaaaatgagaaaaatggaaataaaatacaagaaaaggttatgataaatttcatattattttaccacaataaaaaaattttaataaattataaatggtgtgatatgttttgcctgtgttccacccaaatctcatcttgaattagagctcccacaattcccacgtgttgtggctgggaccctgtgggagataattgaatcatgggggcagtttaccccatactgttctcttggtggtgaataagtctcatgagagttgatggtttgataaggggtttccccttttgcttggctctcattctctcttgactgccaccatgtaagatgtgccttttgccttccaccatgattgtgaagcctcccagccacatggaactgtgagtccattaaacctttttctttacaaatt

SEQ ID NO: 74488 - DNA, 1883 bp, Homo sapiens
agggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaaat

SEQ ID NO: 74489 - DNA, 296 bp, Homo sapiens
cgtcaaagtcccagctttcaaatacagagcccccagaacctgaaatccaagtcccagcccataagggttccgtgaacacgctcatgtgcttgttcttactagacaaagatgtgattgcaagaacaagacccctgccctgggaaactcaacactggacatctcaagctcttcctactcctgaacatgccatggaaccacaactggtgatggagccaaaagccgtgaacagtgggacatttgaaacccctcagcaagcatgcttgctaacatgatttccagggaagtgttattgatga

SEQ ID NO: 74490 - DNA, 373 bp, Homo sapiens
taaaagaggcagcaaattagaacctcaggggaagcactagtatttgaggggaaagaatggagagcaccatttttttgtgcttgaggcatccaggtaagagttccttaaagcaatcttacctttgttttctgccttcagttcctctgccatcaagctgtcttgtcgattaccaagcacaaatgctagaaatgagaggatcagggcatccaaaattccaataatagccaggatgtatgcccagcggactgagcaagccccaagagtgtacttgtctgtcttttctccacacatccgttttacttcatctgagtcccagccatcagggaaaatcatacagccaagcacaaggcaggcagcttggagagaaagagag

SEQ ID NO: 74491 - DNA, 384 bp, Homo sapiens
ccttaaactttgtaggcaatgatatattctgagatgagaccaaaagtatgaatgccattcacagtttgtcaaaatgtcaaggaggtacctgaataaccatgtagcacaggttaataataaatctttatctagttaattcatttgtgcaaatcatggcttccacttgagccccttccctctgtctagtctttcctggttgttcaagccatttttgatcatatggttcctaatctctgagaacaactgatgttcaggttatttgctgtgtgctaacctcatgtcaatttctgaagtcttgagagatagtatccacttaccctatgtaccttatagaacctgggacagtgtgagtccagatttgttctttggtttcctgaggttgta

SEQ ID NO: 74492 - DNA, 183 bp, Homo sapiens
taaaaaacagtagattaatgaggatatatgtaaatggagactttcatgcatttctaaagggagaaatacacagttgatacaagtaatgtgggtaaagaaatatgtatagtcattgcagtagtatatgtaatactatacatatttctttacccacattacttgtatcaactgtgtgtcgacgcg

SEQ ID NO: 74493 - DNA, 974 bp, Homo sapiens
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaag

SEQ ID NO: 74494 - DNA, 2435 bp, Homo sapiens
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgctttaaaaaaaaaaaaaaaaaaaaaaaaaaaagaaaaaaaaccaaaaaaaaaaaaaaaaaaaaacaaaaaaaaatttggggggggccatgccacccccccaggaaaaagatttttgaaaaacaaccctcgcgggggcgaggaggcgagggcccccacagaagagaataatgaacaaaactgtgcacagaaaagggtggtctcatagcaaagacacgtcggtgcacaaaaaaaaaaggggggcgagcgatcaccacaccagaaaaaaacaaacgcgcggggggagacacacgcgctcttttggaaaacacaccccacgagaggcatgagacaccacacggggtaataaaagagcagcaacgacgcaagaaaaaaacgcggcggcagggc

SEQ ID NO: 74495 - DNA, 1531 bp, Homo sapiens
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaggcggttcttcccacctggaagaacatcgggcgtcagacccggaaattcctgcagacaagacgccaggaaacagtctccatcagcggaaacgccactggaacggaaagtccagatccaaagaaggcccacaccaaaggcaagcgcaaa

SEQ ID NO: 74496 - DNA, 2374 bp, Homo sapiens
  misc_feature (1818)..(1818): n is a, c, g, or t
  misc_feature (1823)..(1823): n is a, c, g, or t
  misc_feature (1826)..(1826): n is a, c, g, or t
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgctttaaaaaaaaaaaacacaacanacacnacnacaaaaacaaaagacacaaacacagtggtggcgggccggccgcgcccagaaaagaaagtttctcctccaacccacttgcttgggggggccgcgggcccccagaggataagcaggaaccagtggctcacagctggccgcccaggagagatcggcggcgcgaacgacagtgggtctggttttcccaccaacaaaaaagccgcggcggggaacaccgaggcgtctggaacacacccgagggggcctgccggcggcgacacacgccgtccaacacaagggggccccagagggcccagtaaaaatcccccccccgacgggtgcgtaaaagagacgaaaagactagaaacacaacaagcacgaaagaagaaaagaccaaacgacaagacagcaaggagaccaacaagagaagagacagaaacagcagaagagaacgaaaaaggaaagacagcagaaacacaaatcgtaacacaacagacgataagacacacatacagcgagaacaacagaacacaaacgatcgcaacagaaagcgacgtcaagcagcccgcgac

SEQ ID NO: 74497 - DNA, 2052 bp, Homo sapiens
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgcttta

SEQ ID NO: 74498 - DNA, 2627 bp, Homo sapiens
  misc_feature (2071)..(2071): n is a, c, g, or t
  misc_feature (2076)..(2076): n is a, c, g, or t
  misc_feature (2079)..(2079): n is a, c, g, or t
tgacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgctttaaaaaaaaaaaacacaacanacacnacnacaaaaacaaaagacacaaacacagtggtggcgggccggccgcgcccagaaaagaaagtttctcctccaacccacttgcttgggggggccgcgggcccccagaggataagcaggaaccagtggctcacagctggccgcccaggagagatcggcggcgcgaacgacagtgggtctggttttcccaccaacaaaaaagccgcggcggggaacaccgaggcgtctggaacacacccgagggggcctgccggcggcgacacacgccgtccaacacaagggggccccagagggcccagtaaaaatcccccccccgacgggtgcgtaaaagagacgaaaagactagaaacacaacaagcacgaaagaagaaaagaccaaacgacaagacagcaaggagaccaacaagagaagagacagaaacagcagaagagaacgaaaaaggaaagacagcagaaacacaaatcgtaacacaacagacgataagacacacatacagcgagaacaacagaacacaaacgatcgcaacagaaagcgacgtcaagcagcccgcgac

SEQ ID NO: 74499 - DNA, 7899 bp, Homo sapiens
ttcaagtatggcagacaaaggatgttctgcgtggggaaatgtggtgacacccatttcacaaggacagctcacatagattgagtgctcaggaaggaccagcaccatacccagtgcctgatgtgtatcatctcaattagtccttgcctcagatgcaaaaggaaaccatcgccatcatcatcaccaccatcatcatcttcctcctgtgcagatggaaaggctgaggcatagagaggtgacggagtctgcccaggactgcaagcctgctggtggcagagccaggttccaatggaatgaaggctgtcatcctcagatggcagggtaggcaggtggctagagctcacttgggagaaggggaaaggacactgactttggctagggatggagcagagcttgggctggctttccatgcacgggcagggggcgtggctcatggctacgctccagccccgggtgtggacatttaatcttccaggtctaccctaggctatgggtctggacagcactgtgatggaaagaagacactctatgtcctgcattctgtgaccaatgatgtgactgtgggaatggcgctggcatctggctgccactctgggacgggtggccagctgccatcaggccccacccaggatgggaccaccatgcgacttcttccctcgctcctcctggtcatgtccagagccccaggaggaccagcaaagcctctcgagccgatggcagctcacgttctgccttgtcagctactcctctcctgggcaatattggctgcttgctgtggctctccccggggtatgtgactgcctctgtgctgggcacctggcctgggctttccttctgggcctgggcagctgggctcagcttggacccaggcagcagccacagaggggcccatggaggtgacagagttgcttctatgatggtgaacgggcagctgtgacacggaggaggcgaccactcctgagtttccaagtgctgcggtcagggccggggccagcaaagtccctcccatattcaaagagcgggtttgggtttgtcccaggaggacatagtcaggagcccatgctgggacatgcctcctccaaagttcagcctggatccccagcctctgccaacggccccgctccttagctaacccagcttgctcctgggttccacggcggagtcagatgtttctgggcagtttcacctttgtgccttaaatgcatgttgaggactttaaggaattgtggagaaatagggctgtggcaaaggcaagtgacaactgggaacaatgatcccgcagaggctgctgaggcctgggccccaggggcgtgggttcatccttctgcctgggctttggtgggaggggcagactctgtggtctgagacacaaaaaaacccaaaacatatgtgtgtacagacacacagcagagccacacacacacttgtgcccatgcacacactcacaggaggcccgtggactccgcacagggaagaaactcctccggtcgacagtggacggcgctgcagcagggactcacccccaagccctgcctgcctcccattgcccacctggccctggcttgatgggcttatctcatgctgtggccggggacctcttgcttcctgcaaccccttgctggactggggcctgggcctctcctgggctgtgcctagggtttgtaacccagggcctgtgccggcgtgcacagagcatctctccctgggaggctcagggctgcctcctcgagctctgtgggcctgcactggccggtgagcttgtggtgtgggttttcaggctgtatccttctacctcctgagcccaggggtcccaggcgccctgcagctgtctcctcggccatcctgtggggccccgaggccttgccctcacttcagtgcctgggtgctcaggctttgcccaggtgccaggagaaggtgtgagcatgagcctattggacacacctggcgacgtataccaggtgtcccacccctgccaccatggggcctcccgatacggcaaccaccacggacctgtggggaccaatgaggaaagagagaggcaggtctgggccaggctcacagggactccggcatagcagaccctgccccagcaggcccccttgtccttcctgggtcctggtccttcatgaggaactagcccatccctggtggggctcccaccccgcttctcagtgggctctatgcttgcctcgtcggagtcacccctcaggcagtcctgggatcctctcctttagacccactgtgccttcccggcctcccgggcttctgctgggggcagaagaaatgcctccccaggtctgtctctggaggctctgagggagatgggcttgggggctgtaggaggaggcagggattccagggtgtcaggaaggcaggggtgccaggtcccacctagtgaagtaataaaccgtgggtggtgatagtgacccagtgccctcactgcccagccccgcctgtcctcagccagcactgcagggatcccaggcccagactctggaggccttcactgatcccagccaccccagaaaagctgcagcctgcaggcaccagccgggccatatgcccagtgccagctagggcccaccgcccatcctgcacacggggccgctgggcaggtgcccctcacacccccaggatgtcagtgctcacctcgagcaaagcgccccagctcggccttgggaggtggtcatgtccagggggatgatggagagctgtccaaccaagagagcgggagggagggaaggagggagggagagagatagagagagagagagagagagaggaagtgtgggccctaaggctgccttagtggaggtgcgcgtggcctgcacctcaccaagcctagccactctcgcggctctgagtggctcacaggcttgtgagggccccgtcgctgcctgctgggtccccaccagggctccctctaggaatgcgccatggctgctatgacaatttgcacagcccagtggcttaaacaccatttataccacaggtccagatgaatcctgcagggccagggtctgggggtgctggaggccatgctccctccaggcttgcggggagaacttccctgcctcctccagtctctccatccctgagctctcggctcctcctccgtcttcagggccagggcgtagcgtctgctctctcggcctctgcctccgcttcccacctcacctggcttctgtctatgtcagtctccctctgccaacctcctagaaggacacttgtgattacattagggctcacccctttaatccaggggagcctctccacttcatgattttcagctaacttgcttctgcacagaccccctttccctataagggcacacattcactggtcccggggctaaggaccttgctccaagtccctccacccatgatgctgtgccttccagaaacctgtcctctgcagctcggtcttgaccccaagcctgctggtgacctgaacttcacagggttatccccttggactgtgtgcagcacgatgcaatttctgggcctgaatgtcatgctccctggggcaggaccttgagcctgcagcacacactaggccacctgcagtctcacaggccatgccctgggtagacagggaggtgctcaaccccagctcgggtcctctagtctgcctggctaccatgcttctcactctcctgcatctgcagaccctgcgttgccatgtgaggcaggggtggggtggggctgagggcgtggctttggtccctggctgtccggatgaagtaccagagtgacgccacagcccatcccggtgacatgctcacccccaacccccgtgtccgggaccccggtcttgtgtggtccctgatgtggagtcctcagtccttaagatacatccagaaagtcctggccatgaattggaggtgcagagtcctgcagagcctctgggctgggctggtgcccccaggagatggagggcctggtggatgccctcctccctcagagctggggcagctgcctcccaggggtgggactctgggctcagagagaggcccttgagctgcagctcagggggatgcgaggcttcgtggactgtgtcctggtccatgtggtgcacgtgtctccacctccaaggagaggctcctcagtgtgcacctcccccacatccgtcctctctgccggccccgggcgtctgagcagtcattccatgccagcacctctgcagcctgctgggcctcaggttctctgtgagggacctccccggccttcggcggaggtggagtaagctccgtcaaggcaggtggcttcgtcccttcctgtgagtgacaccagtgatgaaatggacccctccacacaggcatcctcagggcacagggccctgggggcaccttcctcctttcgtatttgttgagaaaaaaagtggcattgcgctcacaccaggatgctggagcagagctgacatgctcgggaaagggcagaggtcactgggggtgggaaggtcatccagtccagactcagcacctcgtgggctggtaaactgaggctcaaagtgctggtgccaggcctgaggcctcgcggtgacccctctctctggttcccagcacctgcctgagacctgccccaggcacccataacctggaattccctgtttccttgtccagggcctgaggaaatggctccccaggtctgtctctggatgctctgaggcagatgggcttgggggctctaggaagaggcagggactccagggtgtcaggaaggcaggggtgccgggtcccacccagtggagtaacaaactgtgggtggcgtttgggcctccccgccttccccactgggtgtgctggtgctggcgctgctgggtcagggctgcccgtgaccccagacaccactgtccatcctgtgaggctcccgtctgggcatgtcctgggtggattcctcctttctgttaagtagctacatgaggcaggggctcctggatccaaagcaaatgacaggaattccagagccaggtgcatccactcagggcagccagtgttggtggagctgcctctagcacatggaggagagtgaaagtcagcctgcccctctcacgagaaaagaacctggggatacctctcagcctccagcgttgcaagtgcaaggccagtggagttaatctgcaacgtgcacgagggcgtgtgtcagtggctgtgtgcaggagtgtgagtgagcaagagcaagagcgcatggctcctgctgtacctcaaggtgtgggctcctggtggctgctcagtgttcccaggggtgagaggcctcatgtatcctaggctgcctgagatttctgtgtgctgatcgcatcctcagtttcttgtccaccgcttcactggcaagagtcccaggctccaaggacaccctccctgcacatgattgggtgttaatggtggcctgggttgtgtcttcccctggggatgagggttgggtgtccatggtgccctgggctgtgtcctcccctagggatgagggtcgggcctccacgatgccctgggctgtgtgctcttatgggaatgagggttgggtgtccaagatgccctgggctgtgtccttccctggggatgagggttggatgtccaagatgccctgggctgtgtactcccctaggaatgagggctgggtgtccaagataccctgggctgtgtcctcccctggggatgagggttgggtgtccatggtgccctgggctgtgtcctcccctggggatgacggttgggtgtccatggtgccctgggctgtgtttccttggggatgagggttgggtgctatggcatcctgggcaggtgcttcctttctgcacaagggttgggtgaccatgatgtcctggcaatggcttccctgggttgcctcttttctgccatgtgggaagagcaggggaggtttagttggtctcagcacatcattctctcaggataagtagaagagtgtctgagctgtgaggccagtgctccagctttggaattgtcttccccaccctcacctccatcccatcaaagcccgacatgtcgtgtggcagcagcgaggtgggtgttggctgttctcttgggctgggggttagtcgtggacggggaaaggagagatgctggtcaaagggcatgaagtttctgctgatgggaggagtcagttcttttgatctgttgcacagcatggtgactatagttaacaataatgactatttcaaaattgctaaaagatgagattttaaatgttctcaccacaaaatgataagtgtgtgaggtgatggatatgccacttaccttgttttaatcatcccacaatatagacaggcattgtcactttgcattgtaccccaggaatcttcacatttgcttttttgtcaattaaaaatagagacacaaaaggagagaggggagagcaatagactcttcacggaaccgtgggcttctgcctccgggtaaaataaactgcaaaaaggattcccaggaaaccgttccctctttcagcccttggttacaggaagccggatttgggaaatctgcctggatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatataggagaaaccatggtaacgtaattagaatagtcagagaaaagtagccagaaatgacattcacatgaacgggcacatacaggaaaacacggtaatgtaattagaatagtcagagaaaagtagccagaaatgacattcacatgaacgggcacatacaggagaaaacacggtaacgtaattagaatagtcagagaaaagtagccagaaatgacattcacatgaacgggcacatacaggagaaaacacggtaacgtaattagaatagtcagagaaaagtagccagaagaatttgcaacgtgcccttgtaacaccaaatttgatcagttttttaaaaaatgatcgttatgtaggtgattgagaagtaaatgtattcttttttaaggtaaaaatttggacccttatcatgcatacccccctctgtgctcttcaaatcaacatcattattaatatctgtacatttttgctcatctgagccagcacaggctgaggctgtcagaatggacaccttttggttgttgggtttctgtcagtttctggggtgaagctgcgtgattgagaacgtagctcttggctgccatctcggggattattaaggactgtgaactctatccacaagccatggcaatatctgtcccaccgaatgctccctctaacacactcttactcccgtgatgtgtgttaagggctccgatgatgctgaaaacagcacaggatgtgaaaaggcaggaacagttctgaagtcaaaggctgatgtcctgtttctctttccctctgtgaccgactcccttcccagtggtaacaagtacccacagcttggtttgaatttctgcacgctgttgtctgtgcactcgctcacacttacgcacacagcaggcatgtgggcgatgctgggtattttgtgtatgagtgggatgcacatacacacatctacatccatatcatgcccatgcatctgtaacttgcttttcccgtgtaagaacacttcttagagtttgttcaatgcatgtgtctgtgtgaatgattgaaggcatttctaacccattttaaagatggctacttaggaccatatggatgttgtactgatgtcatttgaccacgtccattgtttccatcttttgggctgttcttgtgtattttactttccatgtaacactgtgacattgagaattggtacctacaacagtctatttgctttacattaaatttgtaggctaatttgtgtaccttca

SEQ ID NO: 74500 - DNA, 961 bp, Homo sapiens
  misc_feature (10)..(10): n is a, c, g, or t
  misc_feature (12)..(12): n is a, c, g, or t
  misc_feature (138)..(138): n is a, c, g, or t
cgtcaatcanantttgcatttcttctcagccttagtagtttgtgtctttgtagatgtttgttgatttcacccatgttatcaaattgttggcatacacttgttggtaatattccttgatatcaagtattccttgataanattcctttccacctcagtctttttagtggatagatcactattaattacacctcctgctgatgtttcatttcttgttactctaattacaaaatacatacttgaaaatatggaaatgtgtaaaatagaaaatccacagccccaaaacctcatcattactgtttgtctagcatttgcctggctagtctcatgtgcttatttttcccattaacatttagaatcattttgagcaagtttttaaaaaaatgacttcataagtaaatgaggaaaatttttacctatttacaatagagtatcttgaatgtagcatatttatccctttattaagttttttgatgcctttaagtgagttgggttttttttttttcttttttgagacagagtctctgtcgcccaggctggagtgcagtggtgcgatcacagctcactgcagccttgagcttcccaggctcaggtgagcctcccaccacagcctcccaaggaactgggaccgcagataaacaccagcacacttggataatttttttgtagaaacggggtctcagtatgttgcccaggcgggtctgaaactcctgggttcaagcaatccaccagcctcggcctcccaaaatgctgggattacagacgtgagctgctgcatccagctgagattttaaagtatttcataaaagtcttgcacatttctctttgggtggattcttcgggtattttttgttactattgtgaatggaatccttccttttgttgcattttctcattgttatttggatatagacgagctattagttttctcacattaatttgaaatcacccatctatttgggct

SEQ ID NO: 74501 - DNA, 1017 bp, Homo sapiens
  misc_feature (10)..(10): n is a, c, g, or t
  misc_feature (12)..(12): n is a, c, g, or t
  misc_feature (138)..(138): n is a, c, g, or t
  misc_feature (146)..(146): n is a, c, g, or t
  misc_feature (148)..(148): n is a, c, g, or t
  misc_feature (151)..(151): n is a, c, g, or t
  misc_feature (155)..(155): n is a, c, g, or t
  misc_feature (158)..(158): n is a, c, g, or t
  misc_feature (161)..(161): n is a, c, g, or t
  misc_feature (178)..(178): n is a, c, g, or t
cgtcaatcanantttgcatttcttctcagccttagtagtttgtgtctttgtagatgtttgttgatttcacccatgttatcaaattgttggcatacacttgttggtaatattccttgatatcaagtattccttgataanatttctgnanagnccanagnaanatttcttcttcagagtnatgtaatctttatatccttcctttccacctcagtctttttagtggatagatcactattaattacacctcctgctgatgtttcatttcttgttactctaattacaaaatacatacttgaaaatatggaaatgtgtaaaatagaaaatccacagccccaaaacctcatcattactgtttgtctagcatttgcctggctagtctcatgtgcttatttttcccattaacatttagaatcattttgagcaagtttttaaaaaaatgacttcataagtaaatgaggaaaatttttacctatttacaatagagtatcttgaatgtagcatatttatccctttattaagttttttgatgcctttaagtgagttgggttttttttttttcttttttgagacagagtctctgtcgcccaggctggagtgcagtggtgcgatcacagctcactgcagccttgagcttcccaggctcaggtgagcctcccaccacagcctcccaaggaactgggaccgcagataaacaccagcacacttggataatttttttgtagaaacggggtctcagtatgttgcccaggcgggtctgaaactcctgggttcaagcaatccaccagcctcggcctcccaaaatgctgggattacagacgtgagctgctgcatccagctgagattttaaagtatttcataaaagtcttgcacatttctctttgggtggattcttcgggtattttttgttactattgtgaatggaatccttccttttgttgcattttctcattgttatttggatatagacgagctattagttttctcacattaatttgaaatcacccatctatttgggct

SEQ ID NO: 74502 - DNA, 995 bp, Homo sapiens
  misc_feature (124)..(124): n is a, c, g, or t
  misc_feature (126)..(126): n is a, c, g, or t
  misc_feature (129)..(129): n is a, c, g, or t
  misc_feature (133)..(133): n is a, c, g, or t
  misc_feature (136)..(136): n is a, c, g, or t
  misc_feature (139)..(139): n is a, c, g, or t
  misc_feature (156)..(156): n is a, c, g, or t
gcattttttcccaccgcaaaaggtgtggccttgtagaaatttgtttattttcccccgtgttcacatggttgggaaaacctggtggggaaataccctataaccagattccctgaaaatattctgnanagnccanagnaanatttcttcttcagagtnatgtaatctttatatccttcctttccacctcagtctttttagtggatagatcactattaattacacctcctgctgatgtttcatttcttgttactctaattacaaaatacatacttgaaaatatggaaatgtgtaaaatagaaaatccacagccccaaaacctcatcattactgtttgtctagcatttgcctggctagtctcatgtgcttatttttcccattaacatttagaatcattttgagcaagtttttaaaaaaatgacttcataagtaaatgaggaaaatttttacctatttacaatagagtatcttgaatgtagcatatttatccctttattaagttttttgatgcctttaagtgagttgggttttttttttttcttttttgagacagagtctctgtcgcccaggctggagtgcagtggtgcgatcacagctcactgcagccttgagcttcccaggctcaggtgagcctcccaccacagcctcccaaggaactgggaccgcagataaacaccagcacacttggataatttttttgtagaaacggggtctcagtatgttgcccaggcgggtctgaaactcctgggttcaagcaatccaccagcctcggcctcccaaaatgctgggattacagacgtgagctgctgcatccagctgagattttaaagtatttcataaaagtcttgcacatttctctttgggtggattcttcgggtattttttgttactattgtgaatggaatccttccttttgttgcattttctcattgttatttggatatagacgagctattagttttctcacattaatttgaaatcacccatctatttgggct

SEQ ID NO: 74503 - DNA, 572 bp, Homo sapiens
  misc_feature (10)..(10): n is a, c, g, or t
  misc_feature (12)..(12): n is a, c, g, or t
  misc_feature (138)..(138): n is a, c, g, or t
  misc_feature (146)..(146): n is a, c, g, or t
  misc_feature (148)..(148): n is a, c, g, or t
  misc_feature (151)..(151): n is a, c, g, or t
  misc_feature (155)..(155): n is a, c, g, or t
  misc_feature (158)..(158): n is a, c, g, or t
  misc_feature (161)..(161): n is a, c, g, or t
  misc_feature (178)..(178): n is a, c, g, or t
cgtcaatcanantttgcatttcttctcagccttagtagtttgtgtctttgtagatgtttgttgatttcacccatgttatcaaattgttggcatacacttgttggtaatattccttgatatcaagtattccttgataanatttctgnanagnccanagnaanatttcttcttcagagtnatgtaatctttatatccttcctttccacctcagtctttttagtggatagatcactattaattacacctcctgctgatgtttcatttcttgttactctaattacaaaatacatacttgaaaatatggaaatgtgtaaaatagaaaatccacagccccaaaacctcatcattactgtttgtctagcatttgcctggctagtctcatgtgcttatttttcccattaacatttagaatcattttgagcaagtttttaaaaaaatgacttcataagtaaatgaggaaaatttttacctatttacaatagagtatcttgaatgtagcatatttatccctttattaagttttttgatgcctttaagtgagttgggcgataagatcacgggacactctaggc

SEQ ID NO: 74504 - DNA, 381 bp, Homo sapiens
aatgaacaagataaaatacataaagtgtataaaatatataaaataaacataggtgctttgggctactaagttccttttttaaatttctaaattaaaaatttcaactaagttaaacaaaacaaaacacttggactggtgtggtggctcatgcctgtaatcccagcactttgggaggcggaggcaggcgggctgccagagctccagagttcgagaccagcccgggcaacatggaaaaaccccgtctctacaaaaaaacacatggtgcacgcctgtagtcccagctactcagaaggctgtggtgggaggaatacttgagcctgggaggccaaggctgcagtgagctgtgtttgcaccactgcactccagcctgggcaacagaag

SEQ ID NO: 74505 - DNA, 260 bp, Homo sapiens
aacaaaggtccgattatgacatttcattactataatttagtggtaaacgtcctttggctctaaggctttctcctgaaaagctgtcatttgtttgtcaagatacttaaaataataactctttgtttttacagaccttgggtttattctaaaccacttagaaaaatgtgtcagagtgcttcaagcccacagatatgaaatgcccaatttctcttggcccttgcctgttggacatctccaaagagactggcttagttgctgtc

SEQ ID NO: 74506 - DNA, 479 bp, Homo sapiens
ttctcgtcagaccccactgaatatatacaggagttccaatatctaactctgtcctacaatttaacctggagagacttaaatgtcatcctaacttctaccctctccccagatgaacgggaaagagttttttctctagcccaatctcatgtggacaactaccggcttcatgagccaggcctccaggaaggcattagagcagttccctgagaggatccccagtggaactatcaggcagattccccaggtatagctcagtgagattacacgatttcttgcctagttgaagggctttaaaaggcagcatagaaatctgttaattatgacgaacctgaagaaaccacccaaggaaaggttgaaaacgcagccagttcatggctcacttagcagcaatcctgagacgctttacagccttggacccagaggggccagaaggccgtcttgttctcaatatgcgttttatcactcagtccacccatttg

SEQ ID NO: 74507 - DNA, 343 bp, Homo sapiens
aaacaattccaataaagaagtgatcaacaggagtgtccaggcacataatctgtgattcttaagagaaatattaagcaccaccacactccaaagagaagtctaaagataaacagtggacaatttaagatgagatatctaaaacaaatgaaatctggagtcaaaaagatcctatcaaccaacaatctgctatatcactctttagcaaggataacgtggattataatatgtcgtctgcatctatgatcaagttgaaaaaggttaaaaaattataaaactcaatgccactaacggtaaggtagttaaataaataaatggtacaagcataagaaaaatttagaaattt

SEQ ID NO: 74508 - DNA, 453 bp, Homo sapiens
gaagagttgaacaaaaagtgccagtccttggcaggctttttgaaaaatcatactacaagatacaaaaattagaacaaaaactagtaaatgttttgttcaaaatcacaaagaattattttttacagagcagtgtgtctctcctggtcttttatattattaatgtaccatgccacatttttaactgttagaaagaaggaataaaagaaaatgtcccatagtctgtcactttagacgctttaacagtgtttgacaaaatgtaggtaaattcttctaagaacattatcattaacagttgattatggtgttcataagagtggtgatattaagaatttatattttaaaatttagtcatatctgtatgtaatcccaagttgctgactgaacttaaatcttttaaaggataattacaattaaagtgaaaatattttctgcactcatgcttttttctagatg

SEQ ID NO: 74509 - DNA, 416 bp, Homo sapiens
agaataaagctgctcaataaaagctattctttctttactctgaatgggcactatgccgagaatatgcttatagtgcaaccttttaaacgagggggtaaacgtcattaaaatgtggtcactttgggaatttacggcccaagttgaatatatttcagggactctgaggctccttatggaaatgaaacctctaccatttgttagcctatcatatttttgcactggcttatttatttatttgacaaattctgctgtttgtgaccagttcaccttagaccacagatgttaaattcaagttgctaaatgacagtgctattcagactcctttaaaaagaaggccagggtgcagtggctcacacctgtaatcccagcactttgggaaggccaaggcaagaggatcacctgaggttaggagctcg

SEQ ID NO: 74510 - DNA, 398 bp, Homo sapiens
gggctagagtacaatggtacaatcatggctcactgcagcctcgacctcctgcgctcaagcagtcctccctgccttggccttccaaagtgctgggattacaggtgtgaggcacggtgcccagccaatatctttattttaatttgtttttatttcctttatttttagctggttttgtccattttcctaacaaagcagggaccctgggtttctttttagtctgtctgttatataaacttgaagcctgactccattctatttgcctggagttagtatactttcttagggtgaaaggaaggcagcttgtattgagccttttaaagtattgaatgcttgcaaattgctaacattcttttgtgtaaaataaccaataaacctgttttgtcatactctacttaaaa

SEQ ID NO: 74511 - DNA, 371 bp, Homo sapiens
gccaggctggtctcgaactcctgactgaccttgtggtccacctgccttggccttccaaagtgctgggattacaggtgtgaggcacggtgcccagccaatatctttattttaatttgtttttatttcctttatttttagctggttttgtccattttcctaacaaagcagggaccctgggtttctttttagtctgtctgttatataaacttgaagcctgactccattctatttgcctggagttagtatactttcttagggtgaaaggaaggcagcttgtattgagccttttaaagtattgaatgcttgcaaattgctaacattcttttgtgtaaaataaccaataaacctgttttgtcatactctacttaaaa

SEQ ID NO: 74512 - DNA, 549 bp, Homo sapiens
cttccgtcattcctatgggactaaggataatactttgtgttcgggcagaatcattccctgtgtaccaccagcgcggtgtgcatctcttgggccaccaccaacagttacacaagctttgtactttgtaactcccaggagtacaactcacatccatagtttttgcaaatagattccctagagttgtgtggtgtttgactaagcagctcttcacagtgatcttaggagaaaccaaagaccccatcacccagatatgatgctgatggttacaaccagtattaaatcacagaagtcacaaaccagacgccttcaggggcctggcaaataatataaatgagtgaagtaggttgtatataggacagtaggaagtgatggggcaagcacctgctccaccaaaaggcatctaaattcaacaaaaaacaagaagccaggtgcagtagagtgcacctgtagccccagctactcaggaggctgacacaggaggatcccttgagcccagcagttcgagacaagcctgggcaacatagcaagaccccatctttaaaaaaataa

SEQ ID NO: 74513 - DNA, 6457 bp, Homo sapiens
gctgaccagccagtgaggacgcccgctgcctcccacctgccctcctgccgtctttcgccagccaagcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgaaccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcaggctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 74514 - DNA, 4049 bp, Homo sapiens
atggggtttcactatgttgatcaggctggtctcgaactcctgacctcaggtgatccgcccacctgggcctcccaaagtgttgggattaaaggcatcagccattgcacctggcccttacttgcactttctaatgcaaaccaggcctgcgcactgccttgggtcctaaaatcattgcattgactgggtcttctcaaaatcctatatccaagcatcttaggtcttcagctccacctctgaggacccactggggagtctcaggaaacagggaggggtctttcatctcaggaaaaacatggagctcctatctctaccgcccaccccgtgctctacccttcttcctctctgcagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 74515 - DNA, 3654 bp, Homo sapiens
cagttggaagagcacgcaactgatccatcatgggtccatcacgcgccaaccagcgcggaagtgaggcacggaactttgccaggcgagtcgacaatgctgcagggcaggctggaaatgaggctgggagatttggccaggcgagtcccccatgctgcagggcaggccggaaatgaggctcggaggtttggcccgggagtcccccatgctgcagggcaggcccgaacatgaggctgggagatttgcacagggggcccaccatggtctccgtgagggctggaaggagacccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 74516 - DNA, 3575 bp, Homo sapiens
atggggtttcactatgttgatcaggctggtctcgaactcctgacctcaggtgatccgcccacctgggcctcccaaagtgttgggattaaaggcatcagccattgcacctggcccttacttgcactttctaatgcaaaccaggcctgcgcactgccttgggtcctaaaatcattgcattgactgggtcttctcaaaatcctatatccaagcatcttaggtcttcagctccacctctgaggacccactggggagtctcaggaaacagggaggggtctttcatctcaggaaaaacatggagctcctatctctaccgcccaccccgtgctctacccttcttcctctctgcagaaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 74517 - DNA, 2373 bp, Homo sapiens
ctcatggtgtgtgcccaggagaaactggagcaggccgagaagaaggccactgatgctgaggcagatgtggcctccctgagccgccgcattcagctggttgaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 74518 - DNA, 1085 bp, Homo sapiens
ggggacggtgttaccgtggagaccctcgacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 74519 - DNA, 3646 bp, Homo sapiens
gctgaccagccagtgaggacgcccgctgcctcccacctgccctcctgccgtctttcgccagccaagcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgaaccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcaggctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccatcgttgcaacgatggtcctcagctgatccaagtggaaccctttgttaactatact

SEQ ID NO: 74520 - DNA, 409 bp, Homo sapiens
attctgagctcggtacccccagaggcaccaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 74521 - DNA, 2899 bp, Homo sapiens
  misc_feature (2886)..(2886): n is a, c, g, or t
gctgaccagccagtgaggacgcccgctgcctcccacctgccctcctgccgtctttcgccagccaagcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgaaccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcaggctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagaggccgggtcagagccctgggggtgagcctgaaggcacagagaaagaccttgnccaaactcaggca

SEQ ID NO: 74522 - DNA, 346 bp, Homo sapiens
ttaaaagtgaccaaaacaaaacagaaacaaacaacctgatagagacccatagctggtggggatagagaaaggaaatactgcagaaagactcaccttcttaatagtagaggggcgcagagggggttgcaaagtctgtgggcttctgtttctcttctgtataatggatgtaatagtacctaccttcagcctggcgcggtggctcacacctgtaatcccagtactttgggaggccgaggcgggcggatcacgaggtcaggagttcgagaccagcctggccataatgttgaaacctgtctctactaaaaatacaaaaatgaaccgggcgtggtggcaagcgccagtagtc

SEQ ID NO: 74523 - DNA, 563 bp, Homo sapiens
tagcagaaaaaagatgggggaaggatgacagaatttaaaactacagctgctttgttttccagttaaaaatagttctgagttaaaaacgtaaggatgtcccatcacatgtggacaatttatataaaatatagcatactaatacaaataatcatgtcttatgaaaaagtttatagttctagattgttctggtttagcttgaaattgagattcttactgttgcaacataaaaggaagctttgtgaaggaaatatgacatctctgcccagatgcataaggagggaattacagtggggagttatttttagaagtatcttatgaatacatttcatgtactgagaacattttttaaaggttagtttcactggtaggagttatgcaagttgctcgggtcactggatattctattaagaaatcatttttatgttaccaaccaacctagttagtcttaaactggctgatctaagtagtagcttgcttgtttatttagagacagagtctcaccctgtcacccaggttggtgtgcagtggcacagtcatagctcactgctgccttgaactcctga

SEQ ID NO: 74524 - DNA, 482 bp, Homo sapiens
gaatgcacactagaatcacttttgagatgatcactaattttatggagtgatatacaccagaatgaacttctagcctgctttataatcaatcagttaatcaacaagtctgagtggagcgtgtatgctttgcgttatctgcagtgcggcctgaggttacgggagaaaaaaatggcactgtgtattgcttgaatgctcagggctgcgttcaactaattttaaccattgaatcaaaatgatcaggtagagggcaggaaatgtagaatggcttgaacaactacctcatgaaaacatgcagtatgcatttgtaattcagcatcttaaaatgtctcttttggcagtatttctttacaaatgtggcaaagcatgatatctttgagtaaatttttaaacttcacaaaagtttctgaaaaaaatatgtacaatcaaagaaaaacacttggaaataaattctgtctatagtttatgcacatttaatgtatttt

SEQ ID NO: 74525 - DNA, 347 bp, Homo sapiens
aggctggtctcgaactcctgacctcaagtgatcctcctgcctcagcctaccaaagcgctgggattacaggcatgagccaccgtgcccggcctcccttgcattttaatatagagagaagactgcaagtttccctctctggggactcaccctgcagaactcaaaaaatctataaattgtaaaaataataagagataatcatattgaactaactaagatttgaattttgcatggaaagaagcatggctttctttctgtagaaaaaaatttattagggcagtattatgaacatctaatatgttagagccaggcatagtggctcgcacctgtaatcccaggtacttggaggc

SEQ ID NO: 74526 - DNA, 558 bp, Homo sapiens
gaatcactgaatctctgagcctctgttttcttgcaaaagaaggataatactctttcccctattggccccccggctagtcggcaccctgcctaccagcatgagaaggaaagtgctctgggacctaaaagtgccacccagccatcggcctggtgccatggggccctcttctcttcactgcactctggggacttccctcagcgacctgtcttctgctttatcatttgagtttttaatttcaagcaaatatattttgcatttctagatgttctgtctggctcaattcggaaactgcttagccatgatgttaatatcttttttctgctgcatattctgtttttaatcatttttaaaatactttcttaaggtctctttcgattgctcatggggcactaatgcttgtgtttgggtcttcagacctcagggtggagtgttgcctcgtgttttgtaatgtctgtggagcggccaccagaattgcttgaacccaggaggcagaggttgcagtgagctgagatcacgccactgcactccagcctgggcaacagagtgagactgtgtctc

SEQ ID NO: 74527 - DNA, 350 bp, Homo sapiens
gatgggagtttcactcttgtctcccaggctgcagtgcaatggcgtgatctcggctccctgcaatctccacctcccaggttcaagccattctcctccatcagcctcccaagtagctgggattgcaggcatgcgccaccatgcctggctaaatttttttgtatttcagtagagacagggtttcgccatgttggtcaggctggtctcaaactcctgacctcaggtgatccacccgcctcagcttcccaaagtgctgggattacaggcgtgagccatcgtgcccggccgggtatcaggttcttactttgagcagattccatctatcaggtcactggtttatacatattaagtat

SEQ ID NO: 74528 - DNA, 706 bp, Homo sapiens
  misc_feature (1)..(1): n is a, c, g, or t
nccgggctgaggaattcggcacgagctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagccaaaagcctgggactctttgtgaaggtcctcctcacctctatctttctttctctctctctcaaactttccttaaagttctcattgcctttgcactgcttctgggaacagtctttggctcctcccacttttggtgggaatggcggggcagtcctggctcaa

SEQ ID NO: 74529 - DNA, 650 bp, Homo sapiens
  misc_feature (1)..(1): n is a, c, g, or t
nccgggctgaggaattcggcacgagctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctggggtgtggtgtggtatgtgggaagaagttcagaggaaccgttggaaacgacgttaggcattttaccttttcagtaacattttatacatctacttgtcaatgtatttgagacattcacagcctctcaaactttccttaaagttctcattgcctttgcactgcttctgggaacagtctttggctcctcccacttttggtgggaatggcggggcagtcctggctcaa

SEQ ID NO: 74530 - DNA, 1091 bp, Homo sapiens
acggttaccgggcagagccgtgatggctgcggtgcaatggagggactgcaatcctctgtagagctgaggcctgggctgaccccttgggaagctggacgaggtgactgtggagatgctcggtccacgactcaccttccatagcctccaggggtagacaccggtgtgtccaccgctcactggctcatgggttggtcccttatttttattgagacctgttcaatctgttagaaactgactttacataaggcatgaaaagcagcctgcggaatcactagctacacagattgaggataaataccaactcactgacaaacggcacttgtgttcagagtgttcagagacggagtcatttttagaaatgccaggctagagagtgtttcagtatagccacccttgccgaggcttacagaagggcaaagaccaccatctcaagattgatggaagaatcagttttcttggttcaagaaatgaagacggagaaatacaaatgttctaaacaagaagaggtgacagacgagaggctaaaaatgctagagttcctagaagagctcataggaatcaccccatcacaagcaatctttccaaacctcccaggaggccaagagccaagcaagccctgctggtcccttccccaggagtgggcctgggtcttaaagagtgctgcccctcccctccactcaggcctcccaagctgccaggtgcattcactcacttcgactccatctgagggtccaggggagccccttcctgggctggagttcctcccccatcacatgctggacacagcagtcggctccttcatgggcaatttctccaaatttaaagaagactggagatcccggaacacagcaagaaatgtgaaagtttctcagaaagtttgattcgctctcattggcagtgaaagaaatgctatacttgagacactaatctcttcctcaaattgaaacatcatcaaagtacatttctcaagataaagctctgcaaatgttaactatataagtaaataatttacattttattctccaattattgtattatactttgaaaatatatgcagtttgttaataaagacttttagtactcaatagcaa

SEQ ID NO: 74531 - DNA, 386 bp, Homo sapiens
gtattctttatgtgtatcctgtgcaccctcattccatctccatgagttctgtgacgtaggtactattattagctccattttgcattatgaggaaactgaagggagagaaaaataacttgcccaaggtcatattgctggcaagtggaagagccagacctggaagcctggggtatgtggggccacagccctgccttcagaaccaggacctgctgcctgttttgtttagagccttaacatattgtgctcctactttttgaacaatttagaaaataagtgttagaaaaaaatttagaaggacaaagaagaaaaggttttctttcttttaggtaggagatatggaggtctgggaggttaaggagatggatttgattgtagacctatttgaa

SEQ ID NO: 74532 - DNA, 340 bp, Homo sapiens
ctagctctgagtctgttataataggtggtggtgagttgtctgtgtttgaagagaaatgaaggctttgggtgtgagaataggtagacccttgaggggaaaaaaacatggagggaggaggtatagatctggatttgtgcctcggcactgccacatcctaactgcgtaaactagacatagttgttttgcctctgtgagcctcagtttcctcatctagtaaatgacagttcttacctcagggttgccgggataattcattggaagaataggggcaaagcattgagctcagcacctgtcatgcaataaatgctaaaaaaagaaaatagtagctgctgctatttta

SEQ ID NO: 74533 - DNA, 336 bp, Homo sapiens
gagatttacttttaaaggtccagtggccctaatgcccaggagtagtcttctgaaatttttcagaatcaaatctaatgcctttactttcatatagtttttattaaagaattctgtgtagttctgcctccttaatactcttacttttctcccactgttagtatttaaatgatcaccacctctagcgtgaagacttttaacaatctcctgttatatttactgtcctgtatctcctgtccctatactcttctaatctagcttctctccaaaagaacttctagagtaggatttttcagctgattccacagacagatgctagtgtcttgttatcttgtcagg

SEQ ID NO: 74534 - DNA, 521 bp, Homo sapiens
aggagaagagggattaaacctgctagttttggaaaaaaaaaaaaaaaggaaagaaaagaaaagaaagaaagaaaaacaaaaaacaacaacaaacagaaaaatgcaaaactgcagaacacgcagtggaggttggattcagaggacatggggatcagtgtgggctgtgctggtcaaggagggcttccagggagaggcaactgaggattcactgcaattgttccttgagaagatgaggatcaggtcgggaattggaaacatctgagggctcaattcaacctggcttctaaaacgaacatggtgaacatagatcaactactgaacttcttttaacctctggcatcctatctgtgaattgtggggaggaaacagggtccacccgctgctgcacaagaggggtgtgtgcagaccgtcaccttgtgtctgctgtagcaggagacccctggccatgcgggactgaacccatgattgcagctgatcttactctgtctcttctctgtgtgagtaaagtgttgttccatcta

SEQ ID NO: 74535 - DNA, 605 bp, Homo sapiens
aggagaagagggattaaacctgctagttttggaaaaaaaaaaaaaaaggaaagaaaagaaaagaaagaaagaaaaacaaaaaacaacaacaaacagaaaaatgcaaaactgcagaacacgcagtggaggttggattcagaggacatggggatcagtgtgggctgtgctggtcaaggagggcttccagggagaggcaactgaggattcactgcaattgttccttgagaagatgaggatcaggtcgggaattggaaacatctgagggctcaattcaacctggcttctaaaacgaacatggtgaacatagatcaactactgaacttcttttaacctctggcatcctatctgtgaattactcagcgtgtactctttgttctgcttaagcttgtgcgtcatgtggcaggcacctggccaaccccactgttatatctgttccaggtggggaggaaacagggtccacccgctgctgcacaagaggggtgtgtgcagaccgtcaccttgtgtctgctgtagcaggagacccctggccatgcgggactgaacccatgattgcagctgatcttactctgtctcttctctgtgtgagtaaagtgttgttccatcta

SEQ ID NO: 74536 - DNA, 282 bp, Homo sapiens
taaaaaataggaaaacaatagagaaaaatcaaaagctctttctttaaagagaccaacaaatgacaaatctttaattagactgacagaaagtgagagagataactcaaatttctcataacagcaatgaaagacgagccatcactacttataggaatttaaaaaattataaaaggatactataaacagctatgccaacaaatttgataaccaagatgaaatggacaaaatcgtagcaagataaaaattactggaactgactcaagaaatagaaaatcttaattg

SEQ ID NO: 74537 - DNA, 394 bp, Homo sapiens
tatggaaccacgaaagcctcaaatagccaaagcaatcataggcaaaaaggaataaagcaagaggcatcacactactttatttcaaaatgtactaaaaagctaacataatcaaaacagcatggcgctgatataaaaatgcacatgtaaaccagtacaacagaattgagagcccagaaatgaatctacacatttttggtcaattgatctttgacaaagataccaagaagacacaatgggaaaagggcactctctttaataaatggtgttgggacaactagataatcacatacagaaaataaaattggacccttatctcataccataaccaaaaatcaaattaaaatggattaaatacttaaatgtaagacatgaaactgtaaaactaagagaaaaa

SEQ ID NO: 74538 - DNA, 1864 bp, Homo sapiens
ggtactgtgtaaatacggtatacaagattaaaaatggtacacctgtatagggcacttaccataaatggagcatgcgggcctggaagttgctctaggtgagtcagtgaggcttccctgggccacactggaagaactgtctttcttgggccacatatatactaacactaacactaacaatatctgatgagctaaaaaaattgcaaaaaaatctcatgttttaagaaggtttatgaatttgtgttgggccacattaaagcaatcctgggctgcatgcagcccgtgggccgtgagttgaacaagcttggcctaggacattactgtatagcacttgtacagtagtgtacagactttatgaacactgtacatttaggctatacgaaatttataaaaaatatatttcttcaatgataaattaatctttactatagatttttaactttataaactttttacttttaactttttgactctttttgtaacaacacttaccttaaaacacacattatacagctgtacagaaatattttataagcttttttctatttttaagatttatttacttttttactttctaaacttttttcttaaaaactaagacataacacacacattagcctaggcctaaacagcgtcaggatcatcaccatcactgtcttccgcctccacctcttgtcccactggaaggtcttcaggggcagtaacatgcacggagctgtcatctcctttgataacaatgccttctggaatacctgctgaagggcctgcctgaggctgttttacagctaactttttttaataagtagaaggagtatactctaaaatgattaaaaagtatagtatagtataataaatgcataaaccagtaacataattatcaagtattactgtacataattgtaagtgctatacttttatactatgagcagcacagtaggtttgtttacaccagcatcaccaagaacatttgagtaatgcattgcatcacaatattaggatggctacgacgtccacaggcaataggaattttttagctccattataatcttgagaccaccatcacatatgcagtctgtgattaaccaaaacattgttaggtgatacatgaccatataatttattcactatgtgtaacacaaagctccctaaaatatggatcctgccatcagggccttacaatgctgacattgataatgggcatatgagtgaaagaatagtttagtcttaagtatcaggtgctgtgagagatacaaagggaataaaaagcagtttctgtcctccaggagctctttcatcttcttgggaagaaaaaagatttcaaaccttttgctccagccacaattcagagagcccctgaatgagccatatacctttgcagatggtattttcctttcctgaaactgcccttgtgagtttagtaagctccaaccttggtaactcagctcaaaacatcatcatctctctgctctcaaaatcaacacttgcctcaatgaaaagacttaaatattgcatattgattggctggcctttccataaactgtaagctctttgaatatagggtgtttgtcttagattctcaataaatgcttcttgaagtgattttaatttcttttaacctttgtgcttttttgtaatttttaaggttttcttcatcagacatgtattacttttgtaataatataaaaactgactgttccaaagtacagccactagactataaacttcttaaggataggagctatcactaatatgttttccattccctgttgtgcttatagcactgtatgtaagatatttagatagtacttaaaattttgatttgaatgtaaaaataaatgtcaaatgtatattaaatatagtaagtgct

SEQ ID NO: 74539 - DNA, 453 bp, Homo sapiens
actgtgtaaatacggtatacaagattaaaaatggtacacctgtatagggcacttaccataaatggagcatgcgggcctggaagttgctctaggtgagtcagtgagtgagtagtggtgagtggatatgaaggcctaggacaggagtgtacaatcttttggcttccctgggccacactggaagaactgtctttcttgggccacatatatactaacactaacactaacaatatctgatgagctaaaaaaattgcaaaaaaatctcatgttttaagaaggtttatgaatttgtgttgggccacattaaagcaatcctgggctgcatgcagcccgtgggccgtgagttgaacaagcttggcctaggacattactgtatagcacttgtacagtagtgtacagactttatgaacactgtacatttaggctatacgaaatttataaaaaatatatttcttc

SEQ ID NO: 74540 - DNA, 441 bp, Homo sapiens
ccatcagggccttacaatgctgacattgataatgggcatatgagtgaaagaatagtttagtcttaagtatcaggtgctgtgagagatacaaagggaataaaaagcagtttctgtcctccaggagctctttcatcttcttgggaagaaaaaagatttcaaaccttttgctccagccacaattcagagagcccctgaatgagccatatacctttgcagatggtattttcctttcctgaaactgcccttgtgagtttagtaagctccaaccttggtaactcagctcaaaacatcatcatctctctgctctcaaaatcaacacttgcctcaatgaaaagacttaaatattgcatattgattggctggcctttccataaactgtaagctctttgaatatagggtgtttgtcttagattctcaataaatgcttcttgaagtgatttt

SEQ ID NO: 74541 - DNA, 129 bp, Homo sapiens
ggcagaggctgcagtgggccaagatcacaccactgcactccagcctgggtaacagagccagactgtttcgaaaagagagtaagcaaagctggtcaccagtctgtgactattctgtgtctgagtccaggc

SEQ ID NO: 74542 - DNA, 443 bp, Homo sapiens
gacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtaagtgcacattcaaaataaatatatttattctaagtagtattctcatatagtttggcaatgtttctattatagaatttagtagatagcactgaaataatgttgaaacatagtctcacttatttcacatgctagagaaaatacagcctactaccccaacatgaatacaaaatctaatactactagattattgtttaccatggtattc

SEQ ID NO: 74543 - DNA, 360 bp, Homo sapiens
gacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggcggagtcttgctctgtcgcccaggctggagtgcagtggcgcgaccttggctcactg

SEQ ID NO: 74544 - DNA, 5256 bp, Homo sapiens
  misc_feature (308)..(308): n is a, c, g, or t
gacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagnctggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcttacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctatatttggtaaatattttaaagacaaccagatgccagcatcagaagtctgtttgagaactaagagaacagaaacatctatcataagatatatttattttaaaaacacaaggtcactattttactgaatatatttgttttgataactcataccttaataataggtgtgtttgacatatttcttttttcattttgacaatgaactcacattctaatccagaaattttaaacaactactgtgataaataccaatctgctacttttatagattttaccccattaaaatattactttactgacttttactatgtgaagatatatagctttggaaatgtcccaggctattcaagaaatataaaaaactagaaggatactatatataccatatacaatgctttaatattttaatagagctactgtatataatacaaattagggaaatacttgaatatatcattgagaaaaaattattgtcagatcttactgaattattgtcagactttattaaataaagatagaagaaaaccttgctaatgaattaaagtgaaatttgcatgggattcagtttctctaatgttattttccgctgaaatctctaaagaacaagaatgacttcaattagtaaaagtcaattttgggaaaagtcatgggtatctgttttttaagtgtgtcaagttgattaaaatggatgaaacaaattactcatcataagttgtttcttaagctgtcaatatgtcaatagatggtgagttcagaacttatttcaaattgctaagacaaattatctaaattcgtaagaattaacatatagaatggtctggtcagtacatttataatttatctatgcatgaaaaagtattgttttgtttgaaacatgaatttcatagcaagctgccatagaaaggaacgcaggctgttctagaccttcaactgcctaaattatacaaaaattcattttaataaactcaattattagctatttattattcaaagacccatatttaaatcctttgctgaccatgttgacatatatcagccttcttctagacaaactgtcaactctcaaccatcttgacagtagaagtgacagtaaaaaatgttgaatgatcagagattatattaaaataaacatgtaattttcaagtatttttgttgtgcttttataatattaattctagatcagatttattttatagccagggtttgtctgttgtagagtcttgaggcgtagcagtcattcatgattaatcactgttagttttgtacccatatatttttagaatagttttaaatgttagatttctcaaaagctaaatgctacttaatatctttgtatcatactcataaagcaaagtaaatctgacactttttttaaagcaaacttctttgctgtcaaaaaaataaatttggggaaatttctagcttttaaaatgtagatctgcattttactgtgattacttgtgaaagtcatattttaattttctaaattctaatttgtcattttatttcctaaagttaatttccaatgcatttattcataaaatattcattctggaatgcagtgtttgtttaaatgtaatccaatgtatatagaattagtggtggctgtagtgctgtatttattgcttataattttttttaaatgtgaacttacttttaattttctcttggttttaatctgctagtagaaaccactagttatctgtaaaaatatattcaagatattctgatcaattataacaatttatgttatgcctagagtatatctctattttttgattgtatgaaaatattaaagttatgagttaaagtttattttcattgatatttactacagtgccaaataatctaatttataaacataattcttacagtaatcaatgggatacttctcaaaattaacaaatctcttaacaaaatatatcttttgccctctttaaagtcttcagtaaaccagtaaatgaattcaataaaccaattaagaaaaagtcatgatttgtttttcaaactaaaaaaatccaactatactacaatggatgcaaactccttcttatgctgaaagaagaaaaaggatgtctcaaaataagaaaatgttcagaaattcatctcctttatctactatatttcattttgtagttttgtttaaatattagaaagaaaaataagtatttaaaggtaatttttaaagagggcatattcatggctctcacacaaatataaaatgaaaatgtttcaaagatttcgtttaactcattaattaatgaag

SEQ ID NO: 74545 - DNA, 1834 bp, Homo sapiens
  misc_feature (308)..(308): n is a, c, g, or t
gacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagnctggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgatggagaggtatgataattgattttattccttctattattttatatttgctatctgtctatctatccatgtatttaaatgagataaaattataaattccccaggaacaaccatgttaaattctgtttccatcagggaaagaaccatagaatctcttaccataggtttaactctccttctcaaatgctcaggtcatattggagttcaaagccagggaaaagtcaacctcacttaaaaatatttcaaatgctattcatctaatcttttgagatacct

SEQ ID NO: 74546 - DNA, 2993 bp, Homo sapiens
  misc_feature (308)..(308): n is a, c, g, or t
gacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagnctggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcttacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgcta

SEQ ID NO: 74547 - DNA, 305 bp, Homo sapiens
tagacaaggtctcactctgttgcccaggctccgtctcaaaaacaaaacaaaacaaaactcaatatgtataaaactaactcgtgatcctgtctctcttccatccaatcaatcaaagtcccctcatttctgtctcataaaagctctcaaatcttctttcatgaggtcataagggaaaaagaaaaacaaactctcaaaacctttcatttaacctcatctctaccatcaaccaccccaatccagccctctacaatacatcccaatattgtatcacctgcttttttttttttttttttttgtcgacttag

SEQ ID NO: 74548 - DNA, 295 bp, Homo sapiens
atatcaacgcagtgaaaaacaaaaatagtgttataataattagtgtaaaacaattttgatctcataaacctaactgaaggaagaaagctccacaggcaacacgttgagaactccgccctagaaagggcttaaagactacagcctgtggtcaggtatagagggttctcttgtatttataacagtgaaactaatgaggatacattaatttccaaatctttatcttaacttggaagtaagacatgctcataataaaatgtgcttacacggccttcgaacacacttaccacagatgcta

SEQ ID NO: 74549 - DNA, 2224 bp, Homo sapiens
  misc_feature (319)..(319): n is a, c, g, or t
  misc_feature (341)..(341): n is a, c, g, or t
ggaggtgtgtaacgtgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagnaatcattgctgactacgaggtncaccccaaccgacgccccaagatcctggcccagacagcagcccatgtagctggggctgcttactactaccaacgacaagatgtggaggctgacccatgggggaaccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaaggctcaaggaagttaggtttggccaagataaaggccagggaaccagaattcccatctgccttcaaatgagttttttttttttttttagacagagtcttactctgtcacctaggctggagtgcagtggcacagtctctactcaggaggctgaggcagtagaatcatttgagccagggaggcagagattgcagtgagccgagattgcatggctgcactctagcctgggtgacagtgtgagactgtctcaaaaaaaaaaaaaaaagtacctgcctcaggtagggactgaataaacacgtgtaaggcactttggaaaaatacctggcatatatagtaagcagtatgttggccattacgaaaggccctgggaattctgtactgctgctcatgggtgtagtcggttctagaggggtgggcaggtgggagtagctgaggaagacaagtggctggaatggtatcacatgatacacagaagtatcctcagttctgaatctaccttggcctcaagggcccaggagaataacttttcccagctgacagcctctctgaggacaatgacatatgaatgaggatcaaaacgagctttggccaggcactgtggcgctcacctgtaatcccaccattttgggaggctgaggcggaggaccacctgaggcaaggaattcagaaccactctgggcaacataatgacactaaaaaagactatctctaatcaaggctagaaccaagggaaggctaagaattgcccagtactgtgcaactactgaaagccctacccaaggccaccagccttgtcttcctctttcctctgtcagttcaaaaagaacagaaacctccagctcttttacatagcaggtaccaggcatttatcagaagaggccaacttctggttcccatgcagccctttgaatagtgtgtctaaacaaaaataggtgtccaagtagtcacactgagactttaactggtaacccaccctgtggcgtcagtcgcagtgctctggccaacactatagcagggcttattcttctccctcatgtgtagtgaaacaaaatgtaacaccttgggttcattcagttccattccctatgtctacctgtgtcaatataattccctgatttggaggcagctctcctcattttccccaaaacagggaaagcaaggagtaaattcctcttaaaatcaaaagctaataatatgcttcctaaaataaagactcatcaaggtctc

SEQ ID NO: 74550 - DNA, 432 bp, Homo sapiens
tgaatgttggtagacagaagaaaataagctgttgcttccagcaagtggcaattgagcctgtgagcacagctgtgtttggggtgagagactgccctctagggcagcccatacatgctctgttagaaatgctttgagtgcaagtaactgcaaatccagctaatatggccaaaaatacaggttgtgccaaacagtggcacacagggcaaatctggcccttagcccgtttttgaaaatgaagttttctcagaacatagtcacatccatttgttaacatattgtcaaaggctgctgtcacgatataaatgaagagtttagtagtcatgacagagacatatggctggcaaaacttaaaatatctactatgtggcccaaggagtttccagggttagtttcatagctgaacaatactcaggacattgggatagtgtctct

SEQ ID NO: 74551 - DNA, 385 bp, Homo sapiens
acatgagccaacctcattaaagatgtagataaccctggaaaatgttgcagctacatttggcacaattgtgttttgactccctcttgtttaacagttcttgtcagtcttagtttctctgttttctttcaagggagaatcgtagaagccagagtctctagtgttctcaggattcaaggtcaaatccaagggatcagggagagagaaatgtctacctgtagtgacttgtttctcactgatactagcccagcaaaacaaaaaggagctttctctttaaataattgataggacaagttgtaatctgacagaatgaaatgtgtgcattcagctttgaaaccatgtaaataattcaaaagaatgccacatttagccaatgggaaaaaaaaaa

SEQ ID NO: 74552 - DNA, 497 bp, Homo sapiens
cctgatattcccagctcccccggaggcagattaacctttaggcagctttgtgtgagtaaaggagtcgctttaaataggaaggaataatagaaaaaacccaagtgttccgttttatagcaaatgcacactgctttgttcctgctggcctgaaagaggttgcagggggtactggggcggggaattgtccagaaactctgcagatgatacagggacactccagcctagcctctgaggagagttttttttgagacggactcgctctgtctcccaggctggagtgcagtggcccaatctcggctcactgcagcctccgcctcctgggttcaagtgattctcctgcctcagcctcccgagtagctgggattacaggtgtgagccaccacgcctggctaatttttgtacttttagtagagagggggtttcaccatgttggtcaggctggtcttgaactcccgacctcaggtgatactccagcctcagcctcctgagtagctggg

SEQ ID NO: 74553 - DNA, 2891 bp, Homo sapiens
  misc_feature (2571)..(2571): n is a, c, g, or t
acagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcactcgagacgagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctcngaccccacaaagccagatgccacgatggtggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtccaaaaaaaaaa

SEQ ID NO: 74554 - DNA, 2920 bp, Homo sapiens
  misc_feature (2571)..(2571): n is a, c, g, or t
acagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcactcgagacgagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggagagggccaacctgtcatcccaggccctgcagatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctcngaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtccaaaaaaaaaa

SEQ ID NO: 74555 - DNA, 584 bp, Homo sapiens
aagacactgagtgatttgctgaaaatcacacatctagatgcaaagccagaatgcgagcagtgaccaccacacttgacaaatccgttgttgcacacatttgtactcttcaatcaacaaaacctgatgcaaaaaacagaaaagggggagatgtacatgcattttccctcactgcaaaaaaaacacaacttgtttaactacaggtgtgttcctggtggtctttgaatgaagacattgacagaaagtaacatagcatgctggttaaagactgtttttattcgaatcctggctttgccaatcaacagctgcataaattaaactctcgacctcagctcccttatttgtaaaacaagaataacaaaaagacatttttataaggttgggttgaaggttaaatgaaataacagaagattatctcttcactaattttagctgtagaaaacagaagccaatcgaaagagctcccagtccaaagctggaacaacttgaacaacaaaataaataatgtagcattggattacaaaccaaccataaaacaaatatccatgagtctatactgatgtcaataaatgaataaatgtgggaaa

SEQ ID NO: 74556 - DNA, 517 bp, Homo sapiens
tgggggaagctgagcgctgagaccaagggctaaagctgggagactgaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctaatgaaatccaacaccattcttgggctg

SEQ ID NO: 74557 - DNA, 529 bp, Homo sapiens
gagccgggcgagcgctgtgggccaagcaggggttgcagggtagtaggagtgcagactgaatgcagaccgccggggcattattcatttctccagctctgatccgctgttgtaccaggggtctaatcaggcctgtgtctgcctccttcttgaatagcccagtgaattcatctaaacagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggaacccgtctctcaagcagcagctcttctcctatgccattcttggctttgccctgtctgaggccatggggcttttctgtttgatggtcgccttcctcatcctcttcgccatgtgaggctccatgggggggtcaccggcctgttgctaatgaaatccaacaccattcttgggctg

SEQ ID NO: 74558 - DNA, 2927 bp, Homo sapiens
  misc_feature (2918)..(2918): n is a, c, g, or t
gactgcacactgttcttgacacagtggaatagttaggctgtcagaactttggaagctcaggcaaaaatgggattgatctgtttatgctgaattagagagtttcacatctttccccctaaagtttgggaaaacaattaactagaggtgtacatagtttgttagattaattttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggtttggagttttacattgtgggtgagtctaaattcatgcgtttggcaagcacaaaggacatgggaaaagaatctggtatttgaggcaggcttgagtttatatgaagcaaactcagttcctcttcatgtcctatgtatttagagaggacagttttccctcagtttttttccccttccttacccctacccccatcaaatacagcccaaccaaataactgtgttcttaatttaaaggaaaatggcagacttgatacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggccaaggtgggtggatcacttgaggtcaggagtttgagaccaccctggccaacatggtgaaaccctctccctatttaaagaaaaaaaagcaaggcatatcaatttatggttatcaaataggtttttttttttttttttgagactgagtgtcgctctatagcccaggctggagtgtagtgctcactgcgacttccgcctcctgggttcaagtgattctcgtgcctcagtctcccgagtagctgggattgtaggcgcctgccaccacgcccagctaatttttgtatttgtagtagagatggggtttcatcatgttggcgaagctggtcttgaacacctgacctcaagtgatctgccttagcctcactgcttgcccctaagtggtgggattgcaggtgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgctaaattgatttctgtcttgctttgttatcctataataatgttataaaataacattattataaatttcccaagagttgaattaataccaacaactggtaactcgtttttatgtaaacagcatacttgagaccagaaatcttctggatcactttgtggatctctgcctgccattctcattggtcctctgttcatcccttttctagagcttctccttaccttggcttctcttctgccacattggcctgcctgacctgtcctcaggccctgtcactgccctagattacgtttcccatgtcttcacttccaaatctggacctctcgtttagaccttctctcctgactgccagatggcatgtcccactgtcctccggtgtacatctccaaattgtcccacaggcatttatctcagatgaagtttcaggttggactcattcttctgccccaacagcagaatgactcattgagccattgagccattcagcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggcctctgaaggaggtgagcctgggctcttggcctaatgtttcagctctcactttccagtcctgagctgttgttgccagtccatctttcatgagaccattggagtgatctttctggtcttgtcacttcatggtttaaagttccctgggcctacacagtgaagtccaattcngcatggtat

SEQ ID NO: 74559 - DNA, 2590 bp, Homo sapiens
  misc_feature (2581)..(2581): n is a, c, g, or t
gactgcacactgttcttgacacagtggaatagttaggctgtcagaactttggaagctcaggcaaaaatgggattgatctgtttatgctgaattagagagtttcacatctttccccctaaagtttgggaaaacaattaactagaggtgtacatagtttgttagattaattttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggtttggagttttacattgtgggtgagtctaaattcatgcgtttggcaagcacaaaggacatgggaaaagaatctggtatttgaggcaggcttgagtttatatgaagcaaactcagttcctcttcatgtcctatgtatttagagaggacagttttccctcagtttttttccccttccttacccctacccccatcaaatacagcccaaccaaataactgtgttcttaatttaaaggaaaatggcagacttgatacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggcctcaagtgatctgccttagcctcactgcttgcccctaagtggtgggattgcaggtgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgctaaattgatttctgtcttgctttgttatcctataataatgttataaaataacattattataaatttcccaagagttgaattaataccaacaactggtaactcgtttttatgtaaacagcatacttgagaccagaaatcttctggatcactttgtggatctctgcctgccattctcattggtcctctgttcatcccttttctagagcttctccttaccttggcttctcttctgccacattggcctgcctgacctgtcctcaggccctgtcactgccctagattacgtttcccatgtcttcacttccaaatctggacctctcgtttagaccttctctcctgactgccagatggcatgtcccactgtcctccggtgtacatctccaaattgtcccacaggcatttatctcagatgaagtttcaggttggactcattcttctgccccaacagcagaatgactcattgagccattgagccattcagcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggcctctgaaggaggtgagcctgggctcttggcctaatgtttcagctctcactttccagtcctgagctgttgttgccagtccatctttcatgagaccattggagtgatctttctggtcttgtcacttcatggtttaaagttccctgggcctacacagtgaagtccaattcngcatggtat

SEQ ID NO: 74560 - DNA, 2703 bp, Homo sapiens
  misc_feature (2694)..(2694): n is a, c, g, or t
gagactgcctcgccaaatggcgaatttcttatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggtttggagttttacattgtgggtgagtctaaattcatgcgtttggcaagcacaaaggacatgggaaaagaatctggtatttgaggcaggcttgagtttatatgaagcaaactcagttcctcttcatgtcctatgtatttagagaggacagttttccctcagtttttttccccttccttacccctacccccatcaaatacagcccaaccaaataactgtgttcttaatttaaaggaaaatggcagacttgatacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggccaaggtgggtggatcacttgaggtcaggagtttgagaccaccctggccaacatggtgaaaccctctccctatttaaagaaaaaaaagcaaggcatatcaatttatggttatcaaataggtttttttttttttttttgagactgagtgtcgctctatagcccaggctggagtgtagtgctcactgcgacttccgcctcctgggttcaagtgattctcgtgcctcagtctcccgagtagctgggattgtaggcgcctgccaccacgcccagctaatttttgtatttgtagtagagatggggtttcatcatgttggcgaagctggtcttgaacacctgacctcaagtgatctgccttagcctcactgcttgcccctaagtggtgggattgcaggtgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgctaaattgatttctgtcttgctttgttatcctataataatgttataaaataacattattataaatttcccaagagttgaattaataccaacaactggtaactcgtttttatgtaaacagcatacttgagaccagaaatcttctggatcactttgtggatctctgcctgccattctcattggtcctctgttcatcccttttctagagcttctccttaccttggcttctcttctgccacattggcctgcctgacctgtcctcaggccctgtcactgccctagattacgtttcccatgtcttcacttccaaatctggacctctcgtttagaccttctctcctgactgccagatggcatgtcccactgtcctccggtgtacatctccaaattgtcccacaggcatttatctcagatgaagtttcaggttggactcattcttctgccccaacagcagaatgactcattgagccattgagccattcagcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggcctctgaaggaggtgagcctgggctcttggcctaatgtttcagctctcactttccagtcctgagctgttgttgccagtccatctttcatgagaccattggagtgatctttctggtcttgtcacttcatggtttaaagttccctgggcctacacagtgaagtccaattcngcatggtat

SEQ ID NO: 74561 - DNA, 1381 bp, Homo sapiens
gactgcacactgttcttgacacagtggaatagttaggctgtcagaactttggaagctcaggcaaaaatgggattgatctgtttatgctgaattagagagtttcacatctttccccctaaagtttgggaaaacaattaactagaggtgtacatagtttgttagattaattttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggtttggagttttacattgtgggtgagtctaaattcatgcgtttggcaagcacaaaggacatgggaaaagaatctggtatttgaggcaggcttgagtttatatgaagcaaactcagttcctcttcatgtcctatgtatttagagaggacagttttccctcagttttttcccttctttcctaaccattaattggcacaatacggtgttcttaaggacaggcggccgttccgtgagtttggtgcggctttaagggtcccctgggcgtgccggcctttgggcacgttcgttcatgcgggggggccatcgccgggggggctcgtcgc

SEQ ID NO: 74562 - DNA, 1822 bp, Homo sapiens
  misc_feature (1813)..(1813): n is a, c, g, or t
gactgcacactgttcttgacacagtggaatagttaggctgtcagaactttggaagctcaggcaaaaatgggattgatctgtttatgctgaattagagagtttcacatctttccccctaaagtttgggaaaacaattaactagaggtgtacatagtttgttagattaattttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgctaaattgatttctgtcttgctttgttatcctataataatgttataaaataacattattataaatttcccaagagttgaattaataccaacaactggtaactcgtttttatgtaaacagcatacttgagaccagaaatcttctggatcactttgtggatctctgcctgccattctcattggtcctctgttcatcccttttctagagcttctccttaccttggcttctcttctgccacattggcctgcctgacctgtcctcaggccctgtcactgccctagattacgtttcccatgtcttcacttccaaatctggacctctcgtttagaccttctctcctgactgccagatggcatgtcccactgtcctccggtgtacatctccaaattgtcccacaggcatttatctcagatgaagtttcaggttggactcattcttctgccccaacagcagaatgactcattgagccattgagccattcagcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggcctctgaaggaggtgagcctgggctcttggcctaatgtttcagctctcactttccagtcctgagctgttgttgccagtccatctttcatgagaccattggagtgatctttctggtcttgtcacttcatggtttaaagttccctgggcctacacagtgaagtccaattcngcatggtat

SEQ ID NO: 74563 - DNA, 398 bp, Homo sapiens
ccagatagagtttctgtttttcagttttacacgtgccacatcagggaaagttaggttatgattaaagcaagagatgatagatgaacaaacaaagaaacaacaacaaaaagcccatgcaagaggcaggaaaagaggctgactggttaaagaacaggccagattggacaatactgatcaagaggggttcacatttgaaagaacagtgctttattcctctactgactagaactaaagggattttggccgggtacggtggctcacacctgtaatcccaacactctgggaagccaaggtgggcgggtcacgaggtcaggagttcgagaccagcctgaccaacatggtgaaaccccatctctaccaaaaatacaaaaactttgccgagcgtgggccgggcgtgg

SEQ ID NO: 74564 - DNA, 321 bp, Homo sapiens
tccctgagaggaactctggtgcctgctgttaaaaaaataatttcctctctttcactacatgttatggttataagtgtaactgataaaataattagcacagtaattatctttattaactcttcctgttgttttttttttctaagtaaagccttatcctttggtcagtgcagttaatagatgagtcttaattgatgttggcttcctgctgtgaaacataagagttgtgaaatcttggcatcattatgacacctaatcacattttcattttattatggacaagaggaaaatgagttatgattaagctagaacctctctgctaaa

SEQ ID NO: 74565 - DNA, 329 bp, Homo sapiens
atccaccatgcctggcctatagtatgttttaatcatgaagtttgagagtctctggttcccctgggtcctgaggaggggaggacagagatgctcaggacagggtgagagggagccattcacagcaggctgggtgctgagtagatctggtgcttatgtggggaccttcctcctcctccccagtctgccaaaatctcctgtttcccagaaatctctcccaggtgagtgttcaggagaaattgaggtacccaggaggtgagggagcaggctgaagggttcttgggagctttacagtaaacaggaggccctttccctgagatgccccccttcct

SEQ ID NO: 74566 - DNA, 1080 bp, Homo sapiens
tcactgtttacctcaaaactatatacacttataattcgtcaattaattaaaaacaaatgaattcagaatgaatcaaagacctaaatgttagagccaaaacgataaaactcttagaaggaaacagatataaatctttgtgaacttcaattagtcaatattttcatacatgtaacacaaaaagcacacattataaaagaaaatagaagtaaattggactttgtcaaatttaaaaacttgtgctttagaagacagcatcaagaaacttaaaagacaattggagaaaatttttacaaattatgtctggtaagggatttgtatctacagtatgtaaggaattcttacaactcaataataaaaagaaagcccacttgaaaaatggacaaagaatcggcatagacacttctctaaagaagatacacaaatggccagtaagcatacaaaaagatgctcaacatcattattcatcaaggaaatgcaagtcagtaccataatgaatactattatcacactctccataatgactaaaataaaaagacagtaactaatgttggtgaggatatggggaaactggaaccttcatgcattgctggtgtggttgtaaaatgatgcaaaccttgaacaagtttggcacttcctcaaactattaaacattgagttatatgacccagcaattcagcttgtaggtatatatcctaataactgaaaacttacatccacacaaaacatgtacgcaaagtttatagcaatgttatatagccaaaaaaggaacaaataaaatttctagcaactgatgaatagataagaaaatgtcacacacgaaaggccacatattatataattccattctatttatattaaatgtccagaagagacagattgtggagacaaaaagattagtggttctggggagctgggggaaatgagaatgatggctcatggatacaggctttcattttgaggtaatgaacatgttctaaaattagacagcagtgatgattgcacacctctgtaaatgtagtaaaaatcactcagttgtataaggggtgggtttcatgatacatgaagtacagtaaagctttt

SEQ ID NO: 74567 - DNA, 295 bp, Homo sapiens
catgagaccagatgcttgggaggctgaggtgataggatcgcttgagcctgggaggctgaggctgtagtgagccatggtcataccattgcactccagcctgagcgacaaagtgagaccctgtctcaaaaacaaaaacaaaaaaaaatcaaaagaacaaattaaataattgttatgaagttgaacttctaaaacttgttcactgaaatgttttgacccgcattaatgctttatgtcccacatttatattgaaaatccacatgcaaataaaaatggaaaaaccaccaatacctcattt

SEQ ID NO: 74568 - DNA, 483 bp, Homo sapiens
atttcaagtatacatcgacggatgtgcataggttttatgcaaatactatgctaatttctatcagggacttgagcatccatgaattttggtatcactggtcctggaaccagtcccctgtggatacctagggacaactgtatgcaggaaggttattataggacagtcaacaagggaaaacagtgcaaactgattatttcagaaaaggtacatggaatcaggatacagagaaacatcagtctcttgagcctacaatgaaaagcaactccttttatctaggcctactcctaatatttgtgggaaaaaaaacaaatggagacccagaaaccagacatttaaatattttaccatcttaaactaaacttaaaaactgttaaatataatgtcctcttctgctttgacaaatagagcttcatggtggcaaaatgtttaaatatgtaaagctatactttttacttgactgaaaacaaaatatcaagactgctg

SEQ ID NO: 74569 - DNA, 321 bp, Homo sapiens
tctttcttctgtttttttgttttgttttgttttgtgtgtgtgtgtgtgtgtttgtgtgtttggaaaaaatgtgaaaaatagatatatcagaataaagtcttcgtgtaatattatgttaaattatttaataatcagaaaataaaataaaatattttattaaaaatatatatgtataatagttgtatgacaaaataaatctttggccaaatggctttcttataattttgagtagtttgataaaataaaatcatgttaacctacaatagggaaaataataaattgaaaataataacttgaaaattattttatacctgaaaatta

SEQ ID NO: 74570 - DNA, 513 bp, Homo sapiens
  misc_feature (53)..(53): n is a, c, g, or t
cccggccgcgcgacacggctgccgagaagaccgacagaaggggactctgggcncccagatcgtataaatctttcgcctttcactaaagatttccgtggagaggaacaactctgagtcttaagctaattttttgaggccttgttccgacaaggctatataaaactgttaaaaaatcagattgacttcatttgggtgtttcttacagatatcgtttaagttttcggttctgcttgtaaacgctttaatcgctcatgcgtttaaactttgtgtaagtgcaagcgttctttttctagtgaagcttcttccgacaagttagaagtatttacttcagtgtcattaatgtgaaagattcttaaaagtgttctggctgggcgcggtggcttatgccggtaatcccactgcattgggtaaaccaaggtgagcggatcacttgaggtcaggagttcgagaccagcctgggccaacgtggtgaaacccacgttgtacattgttttcttagtcttctgaatcctg

SEQ ID NO: 74571 - DNA, 641 bp, Homo sapiens
gtttggtatatgacctttattgagcttatgcaccagagtggaaataatgcctgtacaaaaccaaatgtttgttactataacttctgcaacactgttaaaatccagtttttaaaaaactcaatcaaaacccactactttggaatcaatagcttctttgaagccatagtaacaattaaatatggttaagactagaatgcagaaattggtcagttggaaagctaattaaacttccaacttgctcagacacaattacaaaaagacaaaattgggctgggggtggtggcttacgcctgtaatcccagcactttgggaggccgaggcaggcagatcacctgaggtcaggagttcgaggccagcctgaccaacatgatgaaacccgtctctactaaaaatacaaaagttagccgggcatggtggcaggcacctgtaaacccagatacttaggaggctgagccaggagaatagcttgaacccaggaggcggttgcagtgagctgagatcatgccattgcactccagcctgggcaacaagagcaaaactctgtctaaaaaaaaaagaaagaaaaagatgaaattatgtttttcacagagatacagcctactggaatcaccacgctggacagctggtaaggtacttagagt

SEQ ID NO: 74572 - DNA, 535 bp, Homo sapiens
taaagatttagatctgggtgtggtggctcatgcctgtaatcccagcactttgggaggccaagtggggaggatcacttgaggccagagttcaagaccagcctgagcaacatagtgattggtattaggtcttcttcacatgtttggtaaaaattcagcaatgaaaccagtaagccccaggctattcttctcaatatctacaaacaaaacaaaaaagttagccaggtcttcgatgtgtgcctgtagtcctagctacttgggagtctgaggtggggggattgcttaagccctggaggttgaggctgcagtgagtcgtgattgctctgctacactccagccggggtgatggagccaagaccttgtctcaaaaaaaaaaaaagactgagtacttaaatttctatatctttttccatcttgaaaggaatattttccaactggtttaatactgttgtttaataagaataagatatatccttaaattaaacaacagtattaaccagattttgagatgcaatgttagccacatttatttcccttt

SEQ ID NO: 74573 - DNA, 422 bp, Homo sapiens
gttttgtttaatctgtatgtttttgtaatctctttttaaaagaatcaatataaataaatagtaataaataataaataggattgaagcttcttaacagagaaaggaagtattattaatatttacttattattaatgttacttactattaaggttatcaaatccatctctcccttctccagcccctactatgtataaagaatgtaggagagagattcatttcaggattattggaattgggggtagaaaaacatagatgaggtaatctgagaacattattttcctcagtaattgcaatatcttttcaacctaatcgtatacttaaattactgacaagaagcaaaatggacttcatgtcttatcttttccatgttcaccttcctaatcctgtaatggcataaacagagaaattccaatcatgtagc

SEQ ID NO: 74574 - DNA, 310 bp, Homo sapiens
tttaaagtaaaaattaactaatgtggaaaagatttcactgtttgagtgtagcagtaattgttggtaaaattccatgtaagagaacactggtacacaagacaaaccatcaaatttgtgattttttttttttgggaaaaccatattatatgataaattaaaattttgaatagtttttgtttactgacctgggactaagtatcctgggttttgcaaaatatggaggatctgtttaccttatcgctaatgggtacagcagagagtggctttcagttattttcaaagtgaactgaagagcctaaccgccctcttt

SEQ ID NO: 74575 - DNA, 760 bp, Homo sapiens
atagcagcatgagaatggactaatacattatctcactgaatataattgctgtaatcccttagtgtaaatctagtaacaatcgtgttttcacagttccctctcataatcatttaattaatttgtttgaattgaaattcataaaagatacagagattgagattcattgacacgtcccttaagtctcttagtttaaaagctctcctaatatatcccacatccccttgtattttatgttgaaatacattttgactccattgaaagaacaaaatcatttgtcctatataattgtacaggtctacagtttgattattgcatccttctgggtatcatttaacttgcttctctgtgtttcttgtacttcctgggaaattattaattatatctagaggcttgattagattcaggtggaattttttaaagatttattccccgggtgactgtgaaccttcccatcagaaggtacatgtctgattttctctccttttttggtgctaacagcccagtgaatataaaattcactcctgtcttttttattgtttttttttgctggaattattctaaaaagagaaatatttttcattacatatttgattaccatgaattatgattgtatagaaaaataaagtaacttactatttcccctttatagtagtattcaaaatagtaaagtggtggtgtatcactttacaaaatctcacaaatcaccactaaagaacttatttatgtaaccaaataccatctgttccccaaaaatctatgg

SEQ ID NO: 74576 - DNA, 355 bp, Homo sapiens
tctttgggttgtaatctattttcatacttatcaggcctagcatatccccagcctacgtgcactgaaatgtaaccctagttattggcctgacttatgggggatgaagcagcagcagctcttgagggcaattcctgttgccttaaggagacagagggctctgtagtgcattcctgtagtggggaagcaaatagggaaagtactatttgaaagagttgggtaacatcttcaggcacaaatggttcaggtgagtctgtaaagccaggcttttcaagggcttccttcccaggtgttcccatttcgtgtttcagatttcaaggttttctacatcaggttgaatccttagcataacagatct

SEQ ID NO: 74577 - DNA, 415 bp, Homo sapiens
taaatatgagcaaaactagaaaccatttaaaatggtgggattctcaagctcgtgctggtgtctcttgcagatagctaaatggtagatgaaatagtgaatgaattgtgagtctctgatttggtctctcctacccaccatcaaggcttatccagagattttcaaatagcttttgcgtaagggagacaataattaagctaattattttccttactgccttatgaaaatataaattaaaacagatgtcacttgctgtcttccatggcatgaacctctgtggacaggagactctacactagactagtaatttagggtctgtttttccccccaagttcagacttaatcagatcagttgcagtgagccgagattgcaccactgatactcacttttttgaggacggggagttgaaaacccttt

SEQ ID NO: 74578 - DNA, 370 bp, Homo sapiens
aagtgaaaaaataatttttattctattttcagtaaacgcgaaattattttctacaaaaattacttaatattggcatcctccactcatgcctgtaaaataaaggtaggtcatcactaaattttaactaatttgacaattgcaaatgtatgtataatatacttatgtactgttggtttgttcatacagttagtccaacttagtccttgtttatctttatatgaaactatggtgccaagaaaaccacgttttgtccccattatgtttaaaaagacaagaattagagaagttgcagagaaaagcacctaaaagctatttggactggtaccctgaatatgaaaaatattgttgaggtgaactttagtgatgtcat

SEQ ID NO: 74579 - DNA, 811 bp, Homo sapiens
ttaggttggtgcaaaagtgcaaaagccacaattacttttgcaccaacttaatataaaataagattgcaataatttctaaaataaagatatttctatcacaaggactagacaaattagtttacagtttacaagctaaagcaaatttagaatgctaaggatgactagtttttcattattctttgccctcagatgaatttttttttctctgtcttggtttctaaaatttccaggttcaccaccaaccctctccttactgcccccaacatatacaaattttgcctacatttatcctctatgtatgtgaatacattcatgtaggctagaaatgccttatactctgccgctggcctggaaagtagtcttcctacaaggggcctttgcacatctctgatttcttccattatgacttggtgctaatttttaaatccaactctcagagtttatggggatccttggtggcaactttaccaccaacaccacccacacacatccccgactcctggtctgtgcctgtgccattttctcagtctttaaacccttttctgtcccctccacctttgaaatccttacttggcaatcacatcctttttcaaatgcctactacctcaattaaacttttattatctccctaagtgaaactttccaatgtatatgatacatattagaaatgaaatcaaagttccccttttctagtcagttccccaaatggctgagccaattctgtactcttcaaattactcttgcttttgcaaggatttttaaattgctttggaagtattcatatttccaaactgtttttaacttctagaaa

SEQ ID NO: 74580 - DNA, 509 bp, Homo sapiens
catagctcactgctgcctcaagctcttgggctccaaagatcctcctacctcagcctccagagctgggggtctacaggcgcgtaccaccatgcccagctactattcttattattcccaaatgccaccccaccatatttctaaaaactcccaaagaaagattctactttgcccagtttgtcctcaattgagcagttttgtctaagcccagagtttctgctgggccagagtatggatgagctgtctctccctggctggtgcccatgcctgcctgtagcctgggagggggagtggcgcccagggtcaggtggaacaaaacatgactgcctagggctgcctctgtctccatctcactgatcgcaaatcacagctcagacagccagctcttaagtgagacctgagtgccagagaggggtggatacaaggccaacagttactaaatgaatgaaaattgtgattccgatgaagcctgccagagaaataaagcattttttaaaagatggaaaaaaggc

SEQ ID NO: 74581 - DNA, 1561 bp, Homo sapiens
ctcctgacctcgagtgatctgcccgtcttgacctctcaaaagtgctgagattacaggtgtgagccaccatgcctggccagaaaaactttggataaagtcaaggtattatataatttgggggaggatgaacgggggtttgtagtactctcgaatattctctaacatcagtgacgtgagtgacccttatatgaatcttcctcagtttcaccagctctaggccccacagggcaaggggacagttatagaaagaagggaccatggacacacaggactaattgcacacccttcctggctcttgttagttcttggggccaggacagctcacaggtgtcagaaagttccagtgagccccagtgaaaagtgggctgaaataattgccagtgattggctcccccactgtgtgtgtgcacgggcgtgtgtgcccaggtgcggtagggagtttcatcgcatctaggagcttcatagtagccataagatcatattgtatttactctgactaaaggccagtgtgggatcaaagactcccttaaaggttcagacacacttacaaattcaccagacacttattttatttgcctgaataatactccctgagcttgctttttctgccagagagaatattctaaatcaggatcactttagaagatttggaagccacatctctatagctgtgtagtgtgtcagatccatccaaatatttaaagcttttttttttttttttgagatatggtcttactgtgtcacccaggctagagtgcagtgacgtaatcatagctcactgcagccttgaactcctgggctcaaatgatcctctcacttcagcctcctgagtagctgggactgcaggtgtttaccaccatacccgactaattttttatttttaaatttgttttgtgaagtcaggttcttactgtgttgccaggctggtctggaacttctggcctcaagcagtcgtcctgcctctgctccccaaagtgctgggcctgagacaccacacccagcctaaactaaaagccatttttagtaactcccaccaatgtggttactgttacaaagttgtatggtttctgggtcatgtttggtatcagaatgtgtatgtatatccttataaatatggaatgtagaactgataatagtttacctatcagatttgcaaaaataaggaaagatttttagcagcttgtaacaaacatatacatacttggataaataatttagaattttaacccatggctcatatgctcttacaatattctctttgagggtaaaacatactttattcttaaacttaaagaacctttgataagccgtgaattatgatctcagtgactacatttctttttaggagttatatgtgggggaaggaaagaagtagctagcagggttaacatggaaagcaggagattatagacaagcatcatttgagcctttggatactacaaataatcttcaaaaatgacaggttttttggctttttgtttttcctttcctttagtgctagttgcagaatcctatcatattgtggttagatttcaataaagaatgtttaagattaggacta

SEQ ID NO: 74582 - DNA, 601 bp, Homo sapiens
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74583 - DNA, 883 bp, Homo sapiens
  misc_feature (849)..(849): n is a, c, g, or t
  misc_feature (853)..(854): n is a, c, g, or t
  misc_feature (856)..(856): n is a, c, g, or t
  misc_feature (867)..(867): n is a, c, g, or t
  misc_feature (870)..(871): n is a, c, g, or t
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtgaaaaaaaaaaaaacaaaaaaaaaaaaaaactttttggggcggcttgggccttgaaaaaggtttttaaaaccttcggtgggggccgggggccccagaggggtaggcgaaccgtggccaaaaggcgggtcccaaggagaaaccggggccaagacaaaggggcggggattccccccatataaaaaacgcccggggggacaccgagggtctcggaacaaatcccagagggggtccgagagggcaacaggggnccanncngggggtccagngannccatataatttg

SEQ ID NO: 74584 - DNA, 554 bp, Homo sapiens
aagcagtggtatcaacgcagagtggccattacgtccgggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74585 - DNA, 748 bp, Homo sapiens
ttccccagggaccacatccagcttttcttccctcccaagagaccagcaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74586 - DNA, 662 bp, Homo sapiens
ttccccagggaccacatccagcttttcttccctcccaagagaccagcaaggctcagtataaatagcagccaccgctccctggcaggagggacccgcagctcagctacagcacagatcagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74587 - DNA, 865 bp, Homo sapiens
  misc_feature (631)..(631): n is a, c, g, or t
  misc_feature (638)..(638): n is a, c, g, or t
  misc_feature (642)..(642): n is a, c, g, or t
  misc_feature (648)..(648): n is a, c, g, or t
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaattagtgaggtctatgtccagagaagctgagatatggcatataataggcatctaataaatgcttaagaaggtggaaanaccaccnccanccaccncacaacacaacacaccacacacaacaccctcgggccgcccccgccccgttaagaaagccctcttgaccagacaaaccatggatgtggagcacgggccccacggagtggcgcagcgaaagcgtcgcccacgagcgggacaccagggacaacaagccggcggatgaagacacgcgtgggggataatctcacccgtttaaaaagcacccgcggggacacc

SEQ ID NO: 74588 - DNA, 693 bp, Homo sapiens
ttccccagggaccacatccagcttttcttccctcccaagagaccagcaaggctcagtataaatagcagccaccgctccctggcaggagggacccgcagctcagctacagcacagatcagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtgccaaaaaattgggacgaagcatccagaaaca

SEQ ID NO: 74589 - DNA, 879 bp, Homo sapiens
aagcagtggtatcaacgcagagtggccattacgtccgggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtgatcgctaaacaacaggagaatggacgggtacctttttgggaccgtgcatctggcccctggaaaagggttttcaaagaccgatcgttgtggggaccgggggctcccctcaggaggcagagcaaacaggtgcaaagagcaggtatgctgaaggaaaacacaccgtggtattaagcaataggcggtggagacttcctgcccgaatttaaacatccgcccgggggagtaacgcggacgctgtctgacaactatctccgaagggctcctagggggccattaacgggagcctttgcacgcggggccccggcgggtcgcgtttaagataccg

SEQ ID NO: 74590 - DNA, 749 bp, Homo sapiens
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcaggcgatgccagagagaatatccagagattctttggcctgcctcagccttccgagtagatggtgtcaggcctctgagcccaagctaagccatcatatcccctgtgatctgcacgtatacatccagatggcctgaagtaactgaataatcacaaaaggagtgaaaatggcctgttcctgccttaactgatgacattccaccacaaaagaagtgaaaatggccagtccctgccttaactgatgacattacctcgtgaaattccttctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74591 - DNA, 701 bp, Homo sapiens
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcaggcgatgccagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattcttcatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgataattttgtaatttaggataagatccaagttattttcccc

SEQ ID NO: 74592 - DNA, 605 bp, Homo sapiens
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcaggcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaa

SEQ ID NO: 74593 - DNA, 419 bp, Homo sapiens
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagctcagggcagggatacaaagcggggagagggtacacaatgggtatctaataaatacttaagaggtg

SEQ ID NO: 74594 - DNA, 897 bp, Homo sapiens
ttccccagggaccacatccagcttttcttccctcccaagagaccagcaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggttatgaatctcaggcacaccttggcatcacctgaaatacccatgccttcaactccccagcagagtctgcagaaactggcctggggtgtggcctg

SEQ ID NO: 74595 - DNA, 916 bp, Homo sapiens
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatctcgacctcccggggctcaagagatcctcccacttcagcctcttgaataactgggactgcagatgtgcgccatgacacttgcctaatttttatattttttgtagagatggggtttcgccgtgtcacccaggctggtcttgaactcctgggctcaagtgatctgcctgcctcagcctcccaaagtgctgggattacaggcatgagtcactgagcccagcctactgttatatttatttttgtgttggtttgaggctgcccagattcacattgtttctggggtcgtctgtgagggtgtttccagaggagattaacatttgaatttggacttaataaagtagattgctatttctcaatgcaactgggcatcacccaatctgttgaaggcttgaataggaaccaaaaatagaggacggaccagattttgcctcccttttcccctgcctcactgcttgagttggacatctcctctcatcttctcttgcctcaaaattgcatttacatgatcaggttgctctggttctcaggcctttgaacctcagactgaatacccctttcctaagttctagcttgcagggcgatcgggggacttctcggccccattttctgtgagccaatccttcataataattcttctac

SEQ ID NO: 74596 - DNA, 679 bp, Homo sapiens
  misc_feature (284)..(284): n is a, c, g, or t
  misc_feature (298)..(298): n is a, c, g, or t
  misc_feature (300)..(301): n is a, c, g, or t
  misc_feature (313)..(313): n is a, c, g, or t
  misc_feature (323)..(323): n is a, c, g, or t
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaataaanaaacaaaaaaaaanannaaaaaaaaaaanaaaaaaaaanaaaaaaaaaaaaaaaaacaaaaaaaaaaaaaaaaacaacatgaggggggaggggcgcgcggcgaccagaatgcccaacaaacgatgtgggcgggcgggcgcgcgcggcagcaagagaagacaaaaagaagagcacagaaggggtgatcacacgcaagacaaggaaccgagggacgagagcagggaggggggacaccaacacacacacagaaaaaaagcgcgccggcgagaggacaaaagaaaggtctattcacacaaccacaagacaaggagagacgtacggaggaaaaagcagagcgaaagaaaaagaaagagcggacaaacagacaaagcatacacacaaaaacaaccccgaag

SEQ ID NO: 74597 - DNA, 1029 bp, Homo sapiens
  misc_feature (634)..(634): n is a, c, g, or t
  misc_feature (648)..(648): n is a, c, g, or t
  misc_feature (650)..(651): n is a, c, g, or t
  misc_feature (663)..(663): n is a, c, g, or t
  misc_feature (673)..(673): n is a, c, g, or t
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtgaaaaaaaaaaaaacaaaaaaaaaaaaaaaaaanaaacaaaaaaaaanannaaaaaaaaaaanaaaaaaaaanaaaaaaaaaaaaaaaaacaaaaaaaaaaaaaaaaacaacatgaggggggaggggcgcgcggcgaccagaatgcccaacaaacgatgtgggcgggcgggcgcgcgcggcagcaagagaagacaaaaagaagagcacagaaggggtgatcacacgcaagacaaggaaccgagggacgagagcagggaggggggacaccaacacacacacagaaaaaaagcgcgccggcgagaggacaaaagaaaggtctattcacacaaccacaagacaaggagagacgtacggaggaaaaagcagagcgaaagaaaaagaaagagcggacaaacagacaaagcatacacacaaaaacaaccccgaag

SEQ ID NO: 74598 - DNA, 1189 bp, Homo sapiens
ttccccagggaccacatccagcttttcttccctcccaagagaccagcaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74599 - DNA, 1176 bp, Homo sapiens
  misc_feature (781)..(781): n is a, c, g, or t
  misc_feature (795)..(795): n is a, c, g, or t
  misc_feature (797)..(798): n is a, c, g, or t
  misc_feature (810)..(810): n is a, c, g, or t
  misc_feature (820)..(820): n is a, c, g, or t
ttccccagggaccacatccagcttttcttccctcccaagagaccagcaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtgaaaaaaaaaaaaacaaaaaaaaaaaaaaaaaanaaacaaaaaaaaanannaaaaaaaaaaanaaaaaaaaanaaaaaaaaaaaaaaaaacaaaaaaaaaaaaaaaaacaacatgaggggggaggggcgcgcggcgaccagaatgcccaacaaacgatgtgggcgggcgggcgcgcgcggcagcaagagaagacaaaaagaagagcacagaaggggtgatcacacgcaagacaaggaaccgagggacgagagcagggaggggggacaccaacacacacacagaaaaaaagcgcgccggcgagaggacaaaagaaaggtctattcacacaaccacaagacaaggagagacgtacggaggaaaaagcagagcgaaagaaaaagaaagagcggacaaacagacaaagcatacacacaaaaacaaccccgaag

SEQ ID NO: 74600 - DNA, 499 bp, Homo sapiens
tccttcacgggggcccctggggttttttcctgggctcccctttggggtcccctgggggtgtggttccaacgcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74601 - DNA, 906 bp, Homo sapiens
  misc_feature (872)..(872): n is a, c, g, or t
  misc_feature (876)..(877): n is a, c, g, or t
  misc_feature (879)..(879): n is a, c, g, or t
  misc_feature (890)..(890): n is a, c, g, or t
  misc_feature (893)..(894): n is a, c, g, or t
ttccccagggaccacatccagcttttcttccctcccaagagaccagcaaggctcagtataaatagcagccaccgctccctggcaggagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggccgatcaggctgccaatgaatggtcgctggtcccctagcactgggcatgctccctgcggccctgttcactagctgtcctctgcctggaacagatctgtcacctctcacttcctcttcactctgctctcaggagatctggctgtgaggccctcagggcagggatacaaagcggggagagggtacacaatgggtatctaataaatacttaagaggtgaaaaaaaaaaaaacaaaaaaaaaaaaaaactttttggggcggcttgggccttgaaaaaggtttttaaaaccttcggtgggggccgggggccccagaggggtaggcgaaccgtggccaaaaggcgggtcccaaggagaaaccggggccaagacaaaggggcggggattccccccatataaaaaacgcccggggggacaccgagggtctcggaacaaatcccagagggggtccgagagggcaacaggggnccanncngggggtccagngannccatataatttg

SEQ ID NO: 74602 - DNA, 1305 bp, Homo sapiens
ttccccagggaccacatccagcttttcttccctcccaagagaccagcaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcagtacaggctagataacccaccaatttccccactgtcctctgatcccctcgtgacagaacctttcagcataacgcctcacatcccaagtctatacccttactgaagaatgctgctctgagcttctgcccccagaatcattccaacgaccacactgcaaagcctatgacagcatcaaatttcaggacctgcagggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtg

SEQ ID NO: 74603 - DNA, 1002 bp, Homo sapiens
  misc_feature (944)..(945): n is a, c, g, or t
ttccccagggaccacatccagcttttcttccctcccaagagaccagcaaggctcagtataaatagcagccaccgctccctggcaggagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacgttggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttactcctttcatttcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagggnncaacttcccggcttccagaccctaccagcactaccctaaccctcagccgacagtttt

SEQ ID NO: 74604 - DNA, 693 bp, Homo sapiens
ggtccttgaggacatttaatatcaggacaaagagcctatgaatatatcactgatgtatataaaccctaaggcgttaataaaagctaactgtttagtgttatccatttaagggaacaggaggaattgcataacttttagattagtcatagtggtgctcctaagggatatgctgttgtatatttgtatagccagggcacttagccttccaaaccaatttatataccatgttcttcaactgtgggtgagatttagcctcaagatttgatttactatatgtaagtacattacttgatttctataaagaatctttagtggaagaggttattctgaattatttatcaatatgattaataccagttagaaattattaatgatcttcctttatactatacataggataacttttaacttgtcgctacagttgttgctctgaggatcttaattttgttactttctaggctacatgaagctatctttttaaaaagtgtactcttcattttcactgttattgtgtacttagcataaaaaactcaaatctaggccaggtgcagtggctcatgcctgtaatcccagcactttgggaggctgaagcatgcggatcacttgagcccaggagttcaagaccagcctgggcaacatggctaatgaacactaagcatagttttgatgtctttcatattaaagactttctca

SEQ ID NO: 74605 - DNA, 520 bp, Homo sapiens
atcctagcagctgagctctgccttcctggggaagtgaagatgagcaaaccattctcacttgcccctttgggtatggactagggaagtagggagagctggccagtcagcacaagggaagactgaagcaggcaagctgagagcatggaagtctccacaaaagagaaacaaaaagtcagaatgcctactccctgcagccacctttatttctgccagcttctggctccatttcaggtcatgcatagcacatgggtttatgcacaaagacctatttttggtatcttccttaaagcaatcaagcaagctgatcccagtaaaggggtaaacccagcaactaagttcacttcttgaccgctccattttcgtatctgtaaggtaatgctaatactatctttttgggaaggttatgaggattaaaaagtcatttgatctctaccaaatgctcagcaaatgcttcatggaagacaagccagctgctgctcttctgtgccctgcagttttcctcccacactctgcctcagca

SEQ ID NO: 74606 - DNA, 722 bp, Homo sapiens
tgccaagcttgtgctcccttgtatccagcacctgggagctaaggcggcggatccctgagcccaggagtttgagacagcccgggcaacagggtgagacgccatccctacctgtgatacgttgtactagctgcattgttggcatgtgcctgcagtcccagctacttgggaggccgaggcgggagtattgcttgaacccgtgaggcggaggttgcagtgagccgagatcacaccactgtactccagataaggagagactcatttctgatgactacctggatccagctatgcctgaagctaatatcccccaggactttttagttatgacttttctttaagtcagttgagtttctataacttgcaaccaagatttctgcctaatacttgctccagctccccttgtcaacctggggacctccactcatccagagatcactggcccccaaggccaagttggctgccctttgtgttcccagatgccctgtgttcccctctagcatagcccttaatatgctgtgttacgatgatcttattccctgtctcttcttttagactagaaactgcttgagggcaggaattgggtcttatgatactgcatcctggtccctagcataggactgtgcttatgttttaaaaactgcttggtgattgaatacattaatgaataaatgaataaaaatgggtatggtctggtagggaccattgctgggatttcacaggaaaga

SEQ ID NO: 74607 - DNA, 1323 bp, Homo sapiens
tatgctgcttcatctgtctaggaatatcagaacgcagttctgtaaatgttcaactcttcagtgcaatgaccccattagccactaggtggagtcagcttcttttttctagcaaggtagaccagccctgggactttactgtttgatttaatgggaagagaacagggtgacttcacgagcccctgtatatgctatttcagttaaccctcaggacaactggcaaagacttgatttcacaggagaaagtcagggacaaagtcttgcagagcttacacaaccaagaagtagccttggagagagatttgatcttagcacttctgctcattcccaaggccgatttccccttccctcaggacatttccctcaggaggccctctctgtttgagggctgtaacttagtcacctgtctagaagtacacctgatgtcaggccagctccacagcccttcttttccttttctcctttgggtgacaaacctgctccattctcagatcctgtggttccgagggactggccctgctctctgattccaggagtgagcctgtgacccgactgagtaatcacagtcatagtcttcagctgttagtgtccagcatgtaaggacagcctgcttcagaactaagccaacacagaggaggccgggctcggtggctcacacctgtaaccccagtactttgggaggccaaagcaggcagattacttgaagtcaggagttcaaggccagctggccaacatgatgaaaccctgtctctactaaaaatacaaaaattagtcaggcgtggtggcgcacgtctgtactcccaattagctggaattacaggcacccgccaccacgcccagctaatttttgtacttttaatagatacagggtttcaccaggttgaccaggctgatctcgaactcccaacctcaggcgattgacctgcctcagcctcccaaagtgctgggattacaggcgtgagccaccacgcccgtctggctaatattttttattagggtctcactccgttgcccaggctggtctcaaactcctaggctcaaggaatcctcctcgctcagcgcctgtaatcccagcagtttgggaggctgaggtgggtggatcatttgaggtcaggagtttgagaccatcctggccaatatggtgaaaccccgtctctactaaaaatacaaaaattagctgggcatggtgacaggtgcctgtaatcccagctacttgggaggctgaggctggagaatcgcttgaacccaggaggcggaggttgcagtgagccgagatcacgccactgtactccagcttgggcgacagagcgagactctcaagaaaaa

SEQ ID NO: 74608 - DNA, 1365 bp, Homo sapiens
tatgctgcttcatctgtctaggaatatcagaacgcagttctgtaaatgttcaactcttcagtgcaatgaccccattagccactaggtggagtcagcttcttttttctagcaaggtagaccagccctgggactttactgtttgatttaatgggaagagaacagggtgacttcacgagcccctgtatatgctatttcagttaaccctcaggacaactggcaaagacttgatttcacaggagaaagtcagggacaaagtcttgcagagcttacacaaccaagaagtagccttggagagagatttgatcttagcacttctgctcattcccaaggccgatttccccttccctcaggacatttccctcaggaggccctctctgtttgagggctgtaacttagtcacctgtctagaagtacacctgatgtcaggccagctccacagcccttcttttccttttctcctttgggtgacaaacctgctccattctcagatcctgtggttccgagggactggccctgctctctgattccaggagtgagcctgtgacccgactgagtaatcacagtcatagtcttcagctgttagtgtccagcatgtaaggacagcctgcttcagaactaagccaacacagaggaggccgggctcggtggctcacacctgtaaccccagtactttgggaggccaaagcaggcagattacttgaagtcaggagttcaaggccagctggccaacatgatgaaaccctgtctctactaaaaatacaaaaattagtcaggcgtggtggcgcacgtctgtagtcccagctacttgggaggccgaggcgggagtattgcttgaacccgtgaggcggaggttgcagtgagccgagatcacaccactgtactccagataaggagagactcatttctgatgactacctggatccagctatgcctgaagctaatatcccccaggactttttagttatgacttttctttaagtcagttgagtttctataacttgcaaccaagatttctgcctaatacttgctccagctccccttgtcaacctggggacctccactcatccagagatcactggcccccaaggccaagttggctgccctttgtgttcccagatgccctgtgttcccctctagcatagcccttaatatgctgtgttacgatgatcttattccctgtctcttcttttagactagaaactgcttgagggcaggaattgggtcttatgatactgcatcctggtccctagcataggactgtgcttatgttttaaaaactgcttggtgattgaatacattaatgaataaatgaataaaaatgggtatggtctggtagggaccattgctgggatttcacaggaaaga

SEQ ID NO: 74609 - DNA, 279 bp, Homo sapiens
ataatctaattgataagaattatagcataagtgcatgtatgtgtatgagaacagtcactctggcatcgcctgcaacagcaaataaatgagtggcaaacaagctctcgcggagggtatttaaatattttatgtgactaagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaa

SEQ ID NO: 74610 - DNA, 539 bp, Homo sapiens
ttgaatcaatcagcccagatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacgtaagtgctccttcctggggattttttgagcacggggattttttgagcatggggatattaagggaatttctcaaaatcatgcagctagtaaataagacatttaggactaggtcctgattattttgactccaggttttatgtgtatttagattaggtttatttagattgctcttgctgcctgtatgttggaaaattaagagcttgttatttccagtgacttctttttactagaaagaccaggaattagttattagcactgaggcccaagtagctatttgcttcttttagacttttggtaaatagaatgatatcccatcccaggattagtcata

SEQ ID NO: 74611 - DNA, 208 bp, Homo sapiens
ttctttccatagtgactagtaatatcaacaggtgtcaaggtctaaacagaaattgcatttaaaaaaaaaaaaagtgtgtcagccaggcgttgtggctcatcatacctgtaaacccaacactttgggaggctgaggcagggggatcacatgagcccaggagttcaagacccgcctgggcaacatagtgagacccgtccctacaaaaaaa

SEQ ID NO: 74612 - DNA, 473 bp, Homo sapiens
caaacttctgatctcaggtgatctgcccaccttggccttgatggttttttttttttaattttggaaaaatctccaccattatctcttcatttatttttttctgcctcatcttctgtcttcttttttggggtctccatgtaaacataagttagaatttttgctgctgtttgacatgtctcatgctctattcttattttttttttcattttgtgcttcagtttggaaaatttctgttgacctgactcttgaggcgctgatcataaacaagataactgggaaaacaatatgtttgtaaaacaatttcttgagatgtgaaatagtatctatattataccaagagtagtcccagctacttgagaggctgaggtaggaggattgctttagcttgggaggtggaggttgccatgagccaggatcatgccactgcactctagcctgggtgacagagggtgacctcatctcaaaaaaaaaaa

SEQ ID NO: 74613 - DNA, 348 bp, Homo sapiens
ggataagtttgtcatttagcccatggtgggggtaagagtcccactttctaaattggtgatttctgtcacatgtctaaggtagaaccagctgcaggcagtggggacttggggactagaacaggcagggaggtggagagctattctggtgggatgtcctaggggctgatgaaagtgagccttgacagcagctttgttctaaaggagcttaaagagaaagcagtggccgggcgcagtggctcacgcctgtaatcccagcactttgggaggccgaggcgggtggatcacgaggtcaggagatcgagactatcctggctaatgtggtgaaaccccgtctctactaaaaataca

SEQ ID NO: 74614 - DNA, 377 bp, Homo sapiens
attaaaaataataataaacagtatcttggcaaaatttgcttccaggaggatgtggcatccaaaacatacattcaataagctattgaatagccaatggcacagttcaattctcacccttgatataagaaatctaccaaatcagaagtattttttgatatattacatatttagactccatgtttaaagaaaggaagatagtataaagtaggtggtaataaataatcatttaatgaatgctcttaggtggcaggataactctttgcttaaccaactcaaccattcaattattttgagtgtggaagaaccattcggaggaacaagggaaacctaacatcaaatttcagttaaggtagtggttacttgagctctagaaaata

SEQ ID NO: 74615 - DNA, 6206 bp, Homo sapiens
agaatcgttagcaactgagcatatttctataaaccaataaaggtttttctgttttgttcatctgttacccttatgctgttgccactttcacatgcagtgtctgtaggcggagagtatgagataacagcatttcacaaatgaaagtgagtggaaaagggctgcttcccctttaaggcagtctcagctccagctccctcccctttcctgattgacaaacctacccgaagtcacatgatctgcctctatttgaaggtcacaaaaagctgcttcctttagagacagagagggagagagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgagagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74616 - DNA, 1104 bp, Homo sapiens
agaatcgttagcaactgagcatatttctataaaccaataaaggtttttctgttttgttcatctgttacccttatgctgttgccactttcacatgcagtgtctgtaggcggagagtatgagataacagcatttcacaaatgaaagtgagtggaaaagggctgcttcccctttaaggcagtctcagctccagctccctcccctttcctgattgacaaacctacccgaagtcacatgatctgcctctatttgaaggtcacaaaaagctgcttcctttagagacagagagggagagagagagcaagagggagagtgtgtgagagagagttagttcaagccaaaatggccgacagagtctctgctggtttctgaatatttaaaatacaaaaaaacagatagacaaaaagaattcattttttggaccttttttcatttccatttctaccttgtatgcctcaatttgctggatttaagcactgctgcactttatgaggttggtaaatattttcaattttttttaaccaattgatttatatggatcttgtctaaccgttttcactggtggtgttgcaaatcgacatttgtctagcatggagactggcttcagacatttcgtggatctgtgtaaatcagacccgtgatgtactttggttcggcattttagaaatggaaaagacgtggtaaaatatttagattttgaagtgatttaattgcacttttaatgtatatgcagattttcatcatcgtttctatcttgcaataaatgaagctgcgagtaattggaaatttgctatttagaaagaggtttttaaaaaacacagacctccccctccccccttaaatctgctgcaaaaatttgcataaatataaatgggtttgcattctttcgggctgctaaggccgacaaaggatctgggagggcaagccctagaacgggaaaggctttttctatctttttattttttaaactgggccctccttcctagagagatgtaaaacctaaagtaagacctaatacattttaaacatcaggttgggggcgggtgaacaccaggaggtttggggtttgtagattcccctgcttgaaaacctcccaagcaatatgtg

SEQ ID NO: 74617 - DNA, 348 bp, Homo sapiens
tgctgcatctgcaaggaattattattctgatgattgttttatatagctgttgcaaagagttaattcattctttccttaaagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaaggtagcctgcttagaaatgttcgcacttgctcattcgctctgagaaggcagaactgaggttttgttttgtttgtttttgttttgagacagag

SEQ ID NO: 74618 - DNA, 6131 bp, Homo sapiens
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74619 - DNA, 6066 bp, Homo sapiens
cccggcccgcggaggcgcgtccgcccctggctggcggtggcagagggaggcgtcaggcctcggatcctcgggtccctgcgcagcgtcccggcctgtgtgcaggacctgcgtgacaagggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74620 - DNA, 5954 bp, Homo sapiens
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatgaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74621 - DNA, 2521 bp, Homo sapiens
ccttggagcaatcggcacagggctcaacccccaaaacttcgctgctagacaaggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74622 - DNA, 2996 bp, Homo sapiens
tgctgcatctgcaaggaattattattctgatgattgttttatatagctgttgcaaagagttaattcattctttccttaaagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74623 - DNA, 5772 bp, Homo sapiens
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74624 - DNA, 1427 bp, Homo sapiens
  misc_feature (6)..(6): n is a, c, g, or t
aagttngaaggtgcagtcaccaatagtggagtagggaagagacttgcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagaaaaaaaggtgggtcattgacagactgtctgagcacatagttgcctcccttataacttcagttttttcgtttggaatatgaatccaaaaagagaacatatcactcttgaaatacttgaatcatgaacgccaacctagaaagacaatgtgaagcaagtacacataccatttaaatttaaacacaaaaaaattaaaaaaattagtttctagtttttcacttttttcatgttatatggaagttgttgctaagaaacatatatactgaaaaaaaatagctttttaactttgtttgcactgggtgtgtttccgtccttaggtctaccatgtttgggagggagggaaattcaaaagaattgttgggggaggggggagggaagacttgacggagcctcactttaaaaacaaaaacacaaaaaacctaaaa

SEQ ID NO: 74625 - DNA, 5691 bp, Homo sapiens
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagattccaaatctatgcaagacggctggggggagagtgacgggccagtcacaggagctcgccatcccagctgggaagaggaggaggatggaggagtctggaacaccactggctctcagggcagtgcttcctcccacaactcagcaagctggggacaaggaggaaagaaacaaatgaagtgctcactcaaaggaggaaacaatgattcatggatgaatcctcttgccaaacagttttcaaatatgggattgctgagtcagactgaagataatccaagcagcaaaatggatttgtctgtaggaagcctttcagataaaaaatttgatgtggacaagcgagcgatgaatctcggggattttaatgatatcatgaggaaggatcgatctgggttccgtccacctaattccaaagacatgggaaccacagatagtgggccttattttgagaagggcggtagtcatggtttgtttggaaacagcacagcacaatcgagaggtctgcacacacccgtgcagccactaaattcttctcccagtctccgggcgcaagtgcctccccagtttatttccccccaggtttctgcctcaatgctcaagcagtttcccaacagtggcctgagtccaggtcttttcaatgtggggccccagttatctcctcaacaaattgccatgctgagccagcttccacaaattccccagtttcagttggcatgtcagcttctcttgcagcagcagcaacagcagcagttgttacagaaccagagaaagatttctcaagctgtacgccaacagcaagagcagcagctggctcgaatggtgagtgcactgcagcagcagcagcagcagcagcagaggcagccaggcatgaagcactcgccctctcatcctgttgggcccaagccgcatctggacaacatggtacccaacgcattgaatgtggggctcccagaccttcaaaccaaagggccaatacctggatatggttctggcttcagctctggcggcatggactatggcatggttggtgggaaggaggctggaaccgagtctcgctttaaacagtggacctccatgatggaggggctgccctctgtagccacacaggaagccaatatgcacaaaaatggcgctatagtggcccctggtaaaacccggggagggtcaccgtacaaccagtttgatatcatccctggtgacacactgggtggccatacgggtcctgctggtgatagctggttacctgccaaatctccaccaacaaataaaatcggaagtaaatccagcaatgccagttggcctccagaattccaaccaggagtgccatggaaaggtatccaaaacattgaccctgaatctgacccctatgtcaccccaggaagtgtgctggggggtacagccacatctcccattgtagatactgaccaccaactgctgcgggataacaccacagggtctaattcttccctcaacacctcgctgccttcacctggtgcctggccctacagtgcctctgacaactcctttaccaacgttcatagcacttcagcaaagttccctgattacaaatcaacatggtccccagatcccataggacacaaccccactcatctctccaacaagatgtggaaaaaccatatttcctccaggaacactacaccgctgccccgcccacctcctggtctgaccaaccccaaaccatcatctccctggagcagcacagcaccccgatcagtcagggggtgggggacacaggactcacggctcgcctcggcctctacctggagtgatggtggctcagttcgtcctagttactggctggttcttcacaatctcaccccacagattgatgggtcaaccttgagaacgatctgcatgcagcatggcccactgctgacattccatctgaatctaacccagggcactgccctgatccgatacagcaccaaacaggaggcggccaaggcccaaactgcactgcacatgtgtgtgttgggaaacactaccatccttgctgagtttgccactgatgatgaagtcagccgctttctggcacaagctcagccccctacacctgcagcaaccccaagtgcgccagctgcggggtggcagtcgctggagaccggccagaaccagtcagatcccgtgggacctgctctgaatctttttggtgggtccactgggctcgggcagtggagcagcagcgctggtggcagcagcggggccgatcttgctggcgcttcattgtgggggcccccaaactattcttctagcttatggggagtcccaacggtggaagatccccataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaagga

SEQ ID NO: 74626 - DNA, 3257 bp, Homo sapiens
ttgtttattttgtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcactcggagccggcacggctcggcgggttgtggttttttgcactgaatgtaacctagactcatcttcacgggcttgtgttgccccaggtactgtcaaaggcagtatttttgtgtttctgcagagttttgcacaaaatctgttcccatgcaaaccaatgagggagaagtatcggaagaaagcagttccaaggtggaacaggaggattttgtaatggaagggcatggcaagactccacctcctggtgaagaaagcaaacaagagaaggagcaagaaagggaagaacagttaatggaagacaagaaaaggaagaaagaggataaaaagaaaaaagaagccactcagaaggtcacggaacaaaaaaccaaagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttactaaaacgtgggcagccccctccaccgtcctgcatgctccttgggggtggggcagggcctcctccctgcacagcacctggagcaaacccaaacaacgcacaagtgacaggagcgctgctgcagagtgagagtgggactgcgccagactcaacccttggaggtgctgctgcttcaaattatgcaaattccacttggggctcgggagcctcctccaacaacggcacctcccccaacccaattcacatctgggacaaggtgattgtagacgggtctgacatggaagagtggccttgtattgccagcaaagacactgaatcttcttccgaaaacaccaccgataacaacagtgcctcgaaccctggctctgagaagagcactctgccaggaagcaccactagtaacaaaggaaaagggagccagtgccagtctgcaagttctgggaacgaatgtaatcttggggtctggaaatctgaccctaaggctaaatctgttcaatcttccaactctactacagagaacaacaatggactaggaaattggaggaatgtgagtggtcaggatagaattggacctggctctggcttcagcaactttaacccaaatagcaacccatctgcctggccagcactggtccaagaaggaacttctaggaaaggggcattggaaacagataatagtaattccagtgcacaggttagcacagtaggtcagacatccagggaacagcagtcaaagatggaaaatgcgggtgttaattttgttgtctctggcagagaacaggctcaaattcataacactgatggaccaaaaaatggaaacactaactccttgaacttaagttcaccaaaccccatggagaataagggaatgccctttggaatgggcttggggaacacctccaggagcactgatgccccttcacaaagcactggagatcgaaagactgggagtgttggatcttggggtgcagctagggggccttctggaactgacacagtctctggacaaagcaattctggaaacaatgggaacaatggaaaagagagagaggactcctggaaaggagcttctgttcagaaatcaactgggtcaaaaaatgactcttgggacaacaataacaggtctacgggtgggtcctggaactttggcccccaggactctaatgacaacaaatggggtgaagggaacaaaatgacatctggggtctctcagggagaatggaaacagccgactgggtctgatgagttgaaaattggagaatggagtggtccaaaccaaccaaattctagcactggagcatgggacaatcaaaagggccaccccctccctgaaaaccaaggcaatgcccaggctccctgttggggaagatcttccagctccacaggaagtgaagttggaggtcaaagcactggaagcaaccacaaagcaggaagtagtgacagtcataactctggccgtcggtcgtacaggcccacacatcctgattgtcaggctgtcttgcagactcttttgagccgaactgatttggaccccagggtgctctcaaacactggctggggccaaactcaaattaagcaggacacagtgtgggacattgaagaggtgccaaggcctgaggggaaatctgacaaaggaactgaggggtgggagagcgctgccacacagaccaagaactcagggggctggggagatgcacccagccaaagcaatcaaatgaagtctggatggggggagctctcagcctctacagagtggaaagaccccaagaacacaggaggctggaatgactacaagaacaacaactcttccaactggggaggaggacgacctgatgaaaagacaccttcctcttggaatgagaatcccagcaaggatcaggggtggggaggtggacgccagcccaatcaaggatggtcttctggaaagaatggttggggggaggaagtcgatcagacaaaaaacagcaattgggaaagttctgcaagtaaacctgtgtctgggtggggtgaaggagggcagaatgaaatcgggacttggggtaatggtggcaatgcaagcctagcttcaaaaggtgggtgggaggattgcaaaagatccccagcatggaatgagacgggccgacagcccaattcctggaataaacaacaccaacagcagcagcccccacagcagccgccgccaccacaaccagaggcttctggttcgtggggaggcccacccccaccacctccaggcaacgttcgaccttccaattccagctggagcagcgggccacagcctgcaacacctaaggatgaggaacccagtggttgggaagagccatccccacagtcaattagtcggaaaatggacattgatgatggcacttcagcatggggagaccctaacagttataactacaagaatgtgaatctgtgggataagaattcccaagggggcccagcacctcgagaaccaaacctgcccaccccaatgaccagtaaatcggcatcagtctggagcaaaagcacaccacctgctccagataatggtact

SEQ ID NO: 74627 - DNA, 435 bp, Homo sapiens
gcagtatttttgtgtttctgcagagttttgcacaaaatctgttcccatgcaaaccaatgagggagaagtatcggaagaaagcagttccaaggtcagtaaattactgaaaggtacagtttgggtagaaattgaacagtagaggctgtggatgagtagaatgggtatttcattttacatgactgtaaaaattcgattgagttaaattagaacctaacataagattgagaaatattttttcttttcagtatactttttaatcctatatgctaatttaaaacaattttactgaactacagagaactttataatttatttttagaacactaatactatgtcttttaaagtttgttacgaaagttactataggcttataaaaaatcagaagtatataaagtcaggagtcaaagctggtcccctgttcctgctgcacagagg

SEQ ID NO: 74628 - DNA, 427 bp, Homo sapiens
tatggagtgtgcttaagggttgtcagctcaactggaggaaaatgtaaccaagagaccgggaatttggtgttacttccctcctggatacttttgattgtgtgacctgtacttcagtgcacagaccctttaggtgtcctcagtaaatcaatctcaggaaactttggttttctgtctttcccccttgttttgtaggcatgtcagcttctcttgcagcagcagcaacagcagcagttgttacagaaccagagaaagatttctcaagctgtacgccaacagcaagagcagcaggtacgtgggtaggcagggtccctccagtgctgtgttggaggagtacatcccggcttagcctctgatggcaaagaaccgggcacagtcttttcctgggaagttcggggccgtgcttatcacgtgtctgtctctcttggcc

SEQ ID NO: 74629 - DNA, 356 bp, Homo sapiens
ccaaggtgggagagtcccttgagcccgagttcaagaccagcatgggcaacatggcaagaccccatctctaaataaaataataaaattatttttaaaatttttagaaaaaatgtatttgatgtatttcaaagactgtttcccaacccctctcttttagtgcccgaagtgacgaaaccaagtttaagccaaccaacggccgccagcccaattggcagctctccatcgccaccagtcaatggtggcaacaatgccaaaagggtggcagtgccgaacggacaaccgccaagcgccgcccgctacatgcctcgggaggtgccgccgcgattccgttgccagcaggaccacaaagtgttact

SEQ ID NO: 74630 - DNA, 337 bp, Homo sapiens
gatgtttaacatataaataagttaaaaataatgcccaaaatagaagcctgttttgagggaggggatgacagagtgagactccgtctcaaaaaaaaaaaaaaaagaaagaaaataatacaatcatttatggctttttgtgttttatttatgtttttatttattagtttttagagtctcgctctgtcgccaggcttgagtgcagtggtgcaatctggctcactgtaacctccacctcctgggttcaaacgattctcctgcctcagcctcctgagtagctgggactacaggtgcacgccactacgcccagctaatttttgtattttttttttagtagaga

SEQ ID NO: 74631 - DNA, 415 bp, Homo sapiens
gaataagaggaacagtttttattactattggataggtgctgcctgaagctttaagacagagaatgtacatttatgcagctgcagtcagagcctgtgtgaggtttactgtaaactcactggcaataaggctcttaacgacattttgatgcccatgaagcttggtgcctagtttaaaactaatgaaaacacctaaactctccaggtggacaaagccatattcaggagaaattgagaaggagttggtgcaggcagccaatcacaatccacttacgccacaaactaaatctcaaactgcggtttgaacatgaggctcaaaacataagaagtaaagaaatgggcaaaattcaattagtttctggtgaaacgtcctaaatccaaaagaaaggtgaccagaaatagagaaaacggagtgtga

SEQ ID NO: 74632 - DNA, 257 bp, Homo sapiens
agaaagtggcaacacagggcagtagcattttttaaagaaaagtttgaaatttgaaagaaaaataggataagtgaagcgtaaaagcagagccaaaggaactgaaggaaaagttgcagtatcaactctactggaccggagccctccgtacctttcaaattgcccttcttgaaacaaatgcttacacctatgaataaatatttgtttacttgctttaatctccaattgtgcagccaatagaacctgactgagctctcccc

SEQ ID NO: 74633 - DNA, 4202 bp, Homo sapiens
  misc_feature (3)..(3): n is a, c, g, or t
  misc_feature (14)..(14): n is a, c, g, or t
  misc_feature (23)..(23): n is a, c, g, or t
cgnccgggacagantggcgggcnggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccggtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74634 - DNA, 415 bp, Homo sapiens
aactttttatctagaaattttatttttttaaaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcatcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74635 - DNA, 4222 bp, Homo sapiens
  misc_feature (3)..(3): n is a, c, g, or t
  misc_feature (14)..(14): n is a, c, g, or t
  misc_feature (23)..(23): n is a, c, g, or t
cgnccgggacagantggcgggcnggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccggtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcagggaaaaaaaacacaaagtcgagc

SEQ ID NO: 74636 - DNA, 4104 bp, Homo sapiens
  misc_feature (3)..(3): n is a, c, g, or t
  misc_feature (14)..(14): n is a, c, g, or t
  misc_feature (23)..(23): n is a, c, g, or t
cgnccgggacagantggcgggcnggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccggtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcccttccccgggagagctggctggagacttggagctccgggaagtaggagtcacatttttttctctattctttggggattttttttacatgaataaaagtggatttcaggga

SEQ ID NO: 74637 - DNA, 3190 bp, Homo sapiens
caccacctgtcggctggtgtggggcctctgacccctgacctcaggtgcacgtctcacccagctgcaccccaactcctgactcccaacctcagcctctcacctctcagagccttcccacaacccggtgatggctctgaaggctgacctctgacctcagtaaaccacatcccacactgggtgtgacctcagacccctaagcccgcattgagttcacctgcccagttggttatcatttcagctgacctctgacctctcacccctgactgttcacctcactatgccccctccttagacatggctctgacttacccctgacctgtaacctctctatgtcatcccttaccccgctattagggctgtggtatgctacttcctgacttctcaccccactgaaccaccctatctgcctccctgctgaatatcactgcagacctttacctttgacctatgacccctctcaacccatactgggttaataccatctgacctcgacctcttggcctctccccaagccacactgccctgagagtaccccttgaattccccactgagtcacctcggcacacactgggaaaaacccctccagacttcctaagcagctgtgtggtcctgacccctcaccctgtggccctgtcctctgcagggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74638 - DNA, 3635 bp, Homo sapiens
gcactcgcaacttacgagcggcagccgtcagctcccttgctggctgtcaaggcaacaccgatctagctaaaacccacctcggtcgtgacccaggtagaggtacatgccatacatttgagatatgcgtccttaacgaacctgacaagcagactgaagggatagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74639 - DNA, 3244 bp, Homo sapiens
  misc_feature (3)..(3): n is a, c, g, or t
  misc_feature (14)..(14): n is a, c, g, or t
  misc_feature (23)..(23): n is a, c, g, or t
cgnccgggacagantggcgggcnggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccggtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccgtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74640 - DNA, 2199 bp, Homo sapiens
tgagacacgcatgaagcactgacagaaccatgagttgtggatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74641 - DNA, 1835 bp, Homo sapiens
taggtcagctcgtctgaaggtctgctttgttaagctttgatggctgtggttagctgtggcctggtagccacagtggcccagggtcagccctgcggctcagctccagtctggcccacaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74642 - DNA, 2340 bp, Homo sapiens
  misc_feature (3)..(3): n is a, c, g, or t
  misc_feature (14)..(14): n is a, c, g, or t
  misc_feature (23)..(23): n is a, c, g, or t
cgnccgggacagantggcgggcnggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccggtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 74643 - DNA, 1898 bp, Homo sapiens
  misc_feature (3)..(3): n is a, c, g, or t
  misc_feature (14)..(14): n is a, c, g, or t
  misc_feature (23)..(23): n is a, c, g, or t
cgnccgggacagantggcgggcnggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccggtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagtcaggtccagtaaaagcactgccaaaaccagaagttg

SEQ ID NO: 74644 - DNA, 439 bp, Homo sapiens
aggcagttgtggacctgggttgtggctgggcagcccctgtgtcccccactcaccgcctccccgtgtatactggccccccaggtctggtctgaggagctattcaagctggctatgaacatcctggctcagaacgcctcccggaacaccttcctgcgcaaagcgtgagccccaggccacccgagggggagccggggggttcacgtggccgttttcagggtgtgacctcttcatctgccttcccagatacacgaagctgaagctgcaggtgaaccaggatggtcggatccccgtcaagaagtgagcaccccttcccccagcaccttcctcctgccctgaccttggtgacctttgtcctccactgaccctgaacccctcctgcccgcatcagcatcctgaagatgttctcagcagacaagaagcgggtggagactgcgctgga

SEQ ID NO: 74645 - DNA, 408 bp, Homo sapiens
tttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcagggaccctgtgtgcagtgtgatttggggtgacaggactctgggccctaagtttcctcatctataaaatggactttgggcatttggtggggttgaggtcacgcctccagccaagggctgctgggttgaacct

SEQ ID NO: 74646 - DNA, 813 bp, Homo sapiens
cttggttattttaatgacaaatgacagaccaataattgattcctcaataaaacagtggaagtcagaaagagtagaattgtacattcagaatgctggcagaaaataaccatcaacctagaattgggcactcagcaaaattatctttcaagaattaaagtatagaaataaaataatttccaggtacatggaaactgaatttaacatctacctacactttttaaaggaagttctaaaagatgtacttcagaaagaaaaattacttcagaaggagagtctgagatagaagtgatgggcaaagaaattgtaaacacatagttgaatctgagcaaacattacatgaaataacaccagacaacaaaagtatgtaagacgagaggtggatgacaaagttaaagaattctaaggtctctctttgtagttaagatatcaattaatagagttgacataattcaagtctttaagtacgcaaggtaaagtttcaaggataaccatgaaagtgtataacttctaatccagccaaaggaaaaaatggactaacaggaaaacacagattaaatgaacaaaaacctaatatcataatgagcattaaaaaaaaagaggatgaaaagaaagcactaaagtaacaaaatagaaataaattcatatatatcaatagtaacaatgaaagtaaataaactttctgatgaaaagccagagattgttggatgacacatacccacaagtttaaaaaataaaaaagccagagattggttgaaaaaaaaaagtgccatttacaagagatgcaccaaaaacattaaggatcgtgaggagttg

SEQ ID NO: 74647 - DNA, 440 bp, Homo sapiens
agatttcaaggctgagatccacaaaactctagcaaatactgcacagacactgaccaatgacagcaggtgctgcctgtcaccctggagcaccaggcaggtttccaaagcacccttgctgtgccagcctctgattgctggttatagggaggtctggggtagtcccaaaagctgggatgtctaaggcagctggggtcagtcaggaggctcagggcagtggcaggaaaatattttcctccctggtagagccacagcggggtatccaggctgaatattattggcgagaaggaccatggcaccgcaccaagacctgcaggacaaactttgttggagctgaatccagaaaaacaatcttcttctaaaccactctcctgcccctcatttaattattgtgcttttgggtgcacttggactactctgaaacattcagaactctgtcaaaa

SEQ ID NO: 74648 - DNA, 474 bp, Homo sapiens
ttagtgcaagttcatatggagtctgatctaaatgtctctgggcaaagaagaacaaatggagatccttgaaaaggctttttgtcattttctttgagagcatctttttggggtacatagagtcttccagatttatgagaatatttttatcaataaccttacctaaaacacataatgtatttttcagggtcattgtgatgtctcacttataaacatactatattaattagagcaaaataatttttacatttctcaatgacctgagttttatttatggagcttataacaataactttgtttctttttttttctgtgaaatgatgtccaaaatgaatctcctttttacattttttttatttttaatattcatgggtacatagcaggtgtgtgtgtgtatacttttagttggaggcaactatatagttttagtgtatatgtatatatttttagtatatctattttatttgtaaagctgta

SEQ ID NO: 74649 - DNA, 518 bp, Homo sapiens
tcatatatttttagcagacctttcccaccaagcagtctctggggagccataaactatccgggttagaaagaggctgcaggtggtatggccccgcagaacgagagccctgccctccagaagaggtctcccccatcagcgggtttccctgtgggctgagggctgttctcttagtgtgtttgattgcactctggggtttccatcctggaataatatcagaactccagtaaaggtcgtgcctcacagttcctttacaaataggacagatgcccagccactcagaaggctgaggcgggaggatggcttgagcccaggagttcaagaccagcctgagcaacatagtgagaccttgtcctacagaacaaataaataatttaaaaattaaacattaaaaaacaaattagccaggcatggccctgcacctgtagtcccagctactcaggaggatcgcctgagcccaggagttcgaggtttgtggtgagctgtgatctcccctgtgaatagccatagtactccagcct

SEQ ID NO: 74650 - DNA, 463 bp, Homo sapiens
  misc_feature (135)..(135): n is a, c, g, or t
  misc_feature (146)..(146): n is a, c, g, or t
  misc_feature (228)..(228): n is a, c, g, or t
catctcccagcccctccggtatgtcaccatcatgaacactcaattgtgtgtgggcctggtagtagccgcctgggtggggggctttgtccactccattgtccaactggctctgatacttccactgcccttctgtgnccccaatatcntagataacttctactgtgatgttccccaagtactgagacttgcctgcactgatacctccctcctggagttcctcatgatctncaacagtgggctgctagttatcatctggttcctcctccttctgatctcttatactgtcatcctggtgatgctgaggtcccactcgggaaaggcaaggaggaaggcagcttccacctgcaccacccacatcatcgtggtgtccatgatcttcattccctgtatctatatctatacctggcccttcaccccattcctcatggacaaggctgtgtccatcagctacacagtcatgacc

SEQ ID NO: 74651 - DNA, 268 bp, Homo sapiens
gggtgcttcattttacaaaactccacctgtgatcctcatacacaaattattgctgcattgttgctgaaatataccccatatatttgactccacgtggtagtactctgaccattcactttaataatcagacttgataatagatacctttgaaaataaattgtatgtttggaaatggcctactgacaaaaccttgtcacaatggagaaggtcaaaaagaaggtattgaaggctctgaaaatggtttgtaaggaggaatgcaaatattgtc

SEQ ID NO: 74652 - DNA, 477 bp, Homo sapiens
acttttgttctctgctgatatttttgtgggtgaaatctgtctgaataaagctatgtcacttacaaattctgcatctctggataaggtcagtcaataggaccaattattgattccatttgtgtcattttcaaaaagccacatttgcattgtgttgactgtgcgatcccagaaaacttgtaataactggtgctctattgtgaactaagaaccaagcgaatgttggtagcaaatgctatgttctactgttagttcttttttagtatcccatctaaaagtaaagcccctatttacagaataagtgctaatatgcttttccccttagcctacctccattgggatggaatagtggatagagttcaggctttggagtcatagagactctacatgggatcaatctctgactagctattgatcttggaaagttacttaaccttaagtctcaattttctcatttgcaagaggaaaatgaaaaaaaaa

SEQ ID NO: 74653 - DNA, 177 bp, Homo sapiens
aatattgggttaagtttggtgagcttgcaggctcatgagctcaggccttggattttaagaaggatacagctaaagctacaccaggcacttgtcagccctaaaattttgctgtgtgtatatatttatatttatatattatagtttttatacatatgtatatatttatttataaatata

SEQ ID NO: 74654 - DNA, 867 bp, Homo sapiens
tgattttcttctacatctcacagggggaagagctggatcaccatgaaatatgtcttctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttcccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaatttgggaatgtagcatactagt

SEQ ID NO: 74655 - DNA, 886 bp, Homo sapiens
  misc_feature (25)..(26): n is a, c, g, or t
  misc_feature (44)..(45): n is a, c, g, or t
  misc_feature (56)..(56): n is a, c, g, or t
  misc_feature (58)..(59): n is a, c, g, or t
  misc_feature (62)..(62): n is a, c, g, or t
  misc_feature (64)..(64): n is a, c, g, or t
  misc_feature (68)..(68): n is a, c, g, or t
  misc_feature (73)..(74): n is a, c, g, or t
tagtgtttaaggtttaaagaagacnnccacaacaccgtatcttnnggggactactncnnacntngaanatgtnntctatttgggtgtcctcgctgggacatttttctttgctgactcatctgttcagaaagaagaccctgctccctatttggtgtacctcaagtctcacttcaacccctgtgtgggcgtcctcatcaaacccagctgggtgctggccccagctcactgctatttaccaaatctgaaagtgatgctgggaaatttcaagagcagagtcagagacggtactgaacagacaattaaccccattcagatcgtccgctactggaactacagtcatagcgccccacaggatgacctcatgctcatcaagctggctaagcctgccatgctcaatcccaaagtccagccccttcccctcgccaccaccaatgtcaggccaggcactgtctgtctactctcaggtttggactggagccaagaaaacagtggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaatttgggaatgtagcatactagt

SEQ ID NO: 74656 - DNA, 449 bp, Homo sapiens
tgcacagaggcccagccattcctgattggcagagacacaattcacatgaacaaggccgacaccctgacttgcggcagaacctggaggcccccgtgatgtctgatcgagaatgccaaaaaacagaacaaggaaaaagccacaggaattccttatgtgtgaaatttgtgaaagtattcagccgaatttttggggaggtggccgttgctactgtcatctgcaaagacaagctccagggaatcgaggtggggcacttcatgggaggggacgtcggcatctacaccaatgtttacaaatatgtatcctggattgagaacactgctaaggacaagtgagaccctacttctccctctgcattccactggctctgccatggactatacaagcagataattttccctctattcaaaataaaatctccaaatgaaaatttgggaatgtagcatactagt

SEQ ID NO: 74657 - DNA, 986 bp, Homo sapiens
gaaatgactatttcattcttgttgtggtgcttctgtaaccttgtgttctgtcccccatgtggacagtgtgccacatctagtttctgcatagatttcaagagagacataaggacaagttttttatgtgtgaggatgcagcttagggcagcaacattgcacaccaattataaaccaataaagttcttgtccctgcctctccctcagcgtctccctcaccagccagtatcagcagatggtctatctcattcttcatgggaaaacagaaactgttcatcttatgcttgggaagcctctctctcttaaccttgagatttcccttcagagatggtcgtttcctccttccctcctgcctaatagaataagttattctcttcgcctaatagaataagttgttctcttcgcctaatagaataagttgttctcttctcttttacctcttttgagacttagcctctttaaagattcccttttgttttagttgtcttcgatttttctttcacttggcttaattccctcagagacataatttaaatcattttcttgatactgtctcctgctcagtttacaccttagcttactccttactgtcaatgaaaatcttgggagggttgtatatgcttcctagctcctctgcctcatgattactcctcagccctcagcatttgcatgccaaactctgaactttcatgttctcagcatgttagtaaaactgttcttgtttcattttacttaagttcgaagcactgtattattgctcccacagccctcagtccaaaacttcagtgcattgtaattgttaaaatcttcatcacattgtattttaatggtctgcgttcatatgtttcctccgtagactaagcttctagaaggcagaaaaatggatttatatagattgcatatttcctttggagttaaatgtaggtcatgacacataaatatatggaaaatacactatccaataaattcacaataaatattggtggaaa

SEQ ID NO: 74658 - DNA, 300 bp, Homo sapiens
tagtgaagttacactcttcctcacccttccccttcccctctataaactaggatctaaattaagggtttcaaaagccccagttaaatgtcaccaaataaaacaaatactaaagtctaaaaaaaggaagattaacttgaattattttaatgttcctaaacttcctataaaaaggattaagaactctggactaggaggcaagtaacttacccttcctgaatttctgtttcctcctttgtaacttaagacctccttgcctatctgaggaaggtcacttagagcactgaatgatatactgtatgt

SEQ ID NO: 74659 - DNA, 492 bp, Homo sapiens
acaagtaacattgttatccccaaagagaaggtggtggtcaagaatattccagggagaaacagcattgaggtgagaagtatcggggtgtgtttagagctctaaaaggagtgaattgagctaagttgttattctttttgttttttagaggcagggtcttgctctgtcacccaggctgaagtgcagtggcatcatcatagctcactgcagcctcgacctcctgggctcaaacaatcctcccacctcagcctcctgagtaacaaggactgcaagcatgcacctccatgcccagctattttattttattttttgtagagacagggtcttgctatgttgcccaggctggtctttaactcctggcctcaagctgtcctccagccttggcctcccaaagtgctgggattataggtgtgagccacctcacctggcctgtattattacagttaattgttaattgtgttaccgtgttgtgctgtgaataatggtaaccactgc

SEQ ID NO: 74660 - DNA, 532 bp, Homo sapiens
gaaaatgcagcttgctggacctcacccccaaaggggttctgtaggtctagggtgggcccgagaatgtgtatctagttcccaggagacgttgacgcaggtccaggacctgattttgagaaccgctgtcctgcagggagcgtaaccccagcctccccaccgcatgctccctgcgggagggtcctgtttcctgcaccaagaacagggcctgggacgcgccagccctggataaatctcatggactgcgcggatggcgctgagggctcctcccagacagtcgccttctctcccaggagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcgaccccaaacactcctccccatccccgccggagcactccctccaggaatgagggaatgaaaacaatgtttctttccagcacattccccaccaggcctatct

SEQ ID NO: 74661 - DNA, 731 bp, Homo sapiens
cgccctcagacctgggctgaactacagccatctggaggggcccctgcccaccctgggcccttaacttccggtgcttctggctgcaggcagcggagcggagcacaggacacttggtgatgtctgagtccagtcctgtttcagatctggtccttgtgtgcccaccgtggctgttgtcagctcttgtcctgcggcccctaatggctggagtccggtactcactgctcacttagggataaaactgctggtggaactgcctaaagtgtgggaggttctgacatccaggggaacctggaggatgtggcactctcatgctgcctctggaaggtccaggaccttcggccttttgaatcctcgatcccagattgtccacctgctctgtgctcccagctccaagtctagctctgctggacagaccattcatctgcccagagcccctcctcggtctctgggccccacacctgactctgaggctacatttgggcatgattcagacctgactccgagccccacaactggccacaggcaccccatctgtctgaggctctcacttgtctctgagaccctggcttcacacctggctctaaactccatttgtcttccaggccccgtgctcggatctgaatcccatgtggggtctgaggtccatagtaaggctcacgtctgccttggcacttagctttacatgggactctcacatctggttttgtaggtaaagttcatggcaaagtagc

SEQ ID NO: 74662 - DNA, 545 bp, Homo sapiens
ctttctggacaagttaagctgtcctgtatgtcgtggaaccaaagctcggtaacctgtggaaaaatgatgagctctggggccacctttgattttcaggggaacctggaggatgtggcactctcatgctgcctctggaaggtccaggaccttcggccttttgaatcctcgatcccagattgtccacctgctctgtgctcccagctccaagtctagctctgctggacagaccattcatctgcccagagcccctcctcggtctctgggccccacacctgactctgaggctacatttgggcatgattcagacctgactccgagccccacaactggccacaggcaccccatctgtctgaggctctcacttgtctctgagaccctggcttcacacctggctctaaactccatttgtcttccaggccccgtgctcggatctgaatcccatgtggggtctgaggtccatagtaaggctcacgtctgccttggcacttagctttacatgggactctcacatctggttttgtaggtaaagttcatggcaaagtagc

SEQ ID NO: 74663 - DNA, 726 bp, Homo sapiens
gtgagccaagatcatgccactgcactccagcctgggtgacaagagtgagtgagactccttctcaaaaaaaaaaaaaaaaaaaaagaatcccagcatgtagcaagcaagcattgctatgtgtctgactttttctcatttatttctcacagcactacttcttcaatgtaaattttttgtccattttacagatgaaaaaactgaggattagagaagtgaaataatcttacccaggggtggcacactttttctgtagaggcccagatatatattttgggctttgtcagccatatgggtctctgtcacaagcatttggcttggctgttattgagagaacacagccataaatacctaaacagatgaaaaaataggaggtgggctggatgtggcccatgggcctcagtttcctggcccctcactcatttcactggtggacacatttctaacatgtaacagaagcaggatttacacccacatttttctgacttcgaagtccttacactttttcctatatgcatggaaacattttaggccaattgtgaaacctggtaactcaaagaaacttttttagatggttacagtatgggcataggtggtgctgtctgcatgaaagcccagaggcacggtggccagccaaacaaccaaacaaacctatggaacctcctggtgtcagtacctcctatacacaaggtggagtatggacatgaataaacctcttgaaaagggact

SEQ ID NO: 74664 - DNA, 1538 bp, Homo sapiens
ggctacgcaagaccttcagttccggattaggaggccccgccccccggcccgagggaggggcggagagacccgctcctgcgacttagggcgatgccaccttaaagggcttgacctcctcgaagccagaactgcggaagaggatggagaaagaaacgctagatagacccaggattcgaacccacaacagcttggatgcaaagctcattttgaattctgaagagctgggagtttagcagtggacgaccaaacaaaaaaataccagaagacggtgaaagcagcagctggaaatgagagaaaaattaagaaatagaaaatgctgtttcatgtattagggagtgcacatctttaaagagaagtgaagaacctttttggctaggcgctttctggggaccttggcagttatcaacaagtcactctgaaactaacagaaggtgaggagggagtaatccagaaaggaaactgccatttttgctagggcaagaaagtagacctagcaatgcaatgccatcaaggagttagctggctctagcgttctccgaactttgcaactcattttatattacattgtctgcgtcaagaaatttcaagtaaatgccttgagattttatatgtataaaatgtagtctctggccaggcggggtggctcacgcctgtaatcccagcactttgggaggctgaggcgagtagatcacgatgtcaggagatcaagaccatcctggctaacatggtgaaaccccgtctctactaaaaaatacaaaaaattagccgggcatgatggtgggcgcctgtagtcccagctactcgggaggctgagacaggagaatggtgtgaacccgggaggcagagcttgcagtgagccgagatcgcgccactgcactccagcctgggcgacagagcgagactccgtctcaaaaaaaaaaaaaaaaaaaaaagtctcagaagaagtgtcaagttgactaaatgatttttaagtcccttccactctactatatcacaataatttcccctattttaccttatttaattttcacaacaaccctgcagcctgtaagtaggtgactcctccatggtcagcaggtggtcagtggtcgaactatttaggactatctgatgctctttcctctgctcaccattgcaatacaatgagaaaaatgcaaatgaatctaagtacagtgttctctgggaatatgaagatagaactaaaaactgcctgagagatcagggcaggcttctagaaagttgtgtctaactagtcttgaggtttacataaaccacaccaggctgatgggactgggaagggcccactaagcagtgagaccattcccttttggagagtccttgcatcccctcccagatttcctctttgaggggaaggtgagagaggaggtaaaaggggtgaggaatggagaataactcattctggttcttgtttccccttttccacataaaagtatatttgtcttgtgttccatacaccagtccatactgatgtgatggtgttttttatgcttccttttgaataaacatttcattcttaa

SEQ ID NO: 74665 - DNA, 535 bp, Homo sapiens
ggcccggcagtgtgtatgtggggataactgtgaaaggatataggacttcatttggagtgataaaagtcttcaaagttgattgtgttggtggctgcacaactctgaatatactataaaccactgaatttgcactttagaaagtatgtccttgctacattccttttttggagttcttttatttcattcttttggaatcggagagaaacaagttgctgccccaggaaagcgtgcattttcggagatcactcattgcagaagaagccaactgccatgccagaggggcactcaaacagctctgcaaggaagtccctgtgataagcaactgaagactctgccatcggccatgagagcgccaccttggaaacagattcttcagccttagtcaaattttcagaagactgtatgtccagccaacttcttgactacaatccctttatagatcccaagctagaacctcccagctaagccactcctggattcctgaccctgagaaactctgtgagagaataaatgtttattcttgccttaagctcct

SEQ ID NO: 74666 - DNA, 842 bp, Homo sapiens
tctcgctctgttgcccaggctgcagcgcagtggctcaatctcggctcattgcaaactctgcctcccgcttcaagtgattctcctgcctcagcctcccgagtagctggaattataggcatgtaccactacacccagctaatttttgtatttttagtagaaatgggttttcaccattttggtcaggctggtctcaaactcctgacctcaagtgatccacccacctcagcctcccaaaatgcggggattacaggcatgaaccactgcacccagcccatactattatattggctattataattattaatcataatattaatattactttgggaggccgaggcaggcagatcacttgacatcaggagtcaagaccagcctgggcaacatggtgaaacaccatctgtactaaaaatacaaaacattagctgggcatggtggcgtgtgcctgtaatcccagttactcggaaggctgaggcaggagaattgcttgaacctgggaggcagaggttgcagtgagctgagatcctaccactgcactccagcctggatgacagagtgagattccgtctaaaaaaaaaatttgttataaatattaatagttagacatttccattttgtgaccacattctctgaattatcctcatgtttagcattttatttatttattatatcacccagcctggaatgcagtgatgccatttcagctcactgcaacctccgtctcctgggcaacatggtgaaacaccatctgtactaaaaatacaaaacattagctgggcgtggtggtgtgtgcctgtaatcccagttactcaaaaggctgaggcaggagaattgcttgaacctgg

SEQ ID NO: 74667 - DNA, 366 bp, Homo sapiens
ttaattatgaatctgctttgcaagaccctaaaataaagccatccatgaagcaaagcaattttcgtggccctgtgactgatcatgtgcttgccacttggctgatacccctggaccgtggcctgaagtgtcattactcttggctccagtctccagaaaacccagacataaactcactgtggtggatgcagatcaaaatgccatcccagagctggcttttaaaatgttttgaaaaattcattatccctctaagccattagatcactttgagccttatggggaacaaatgcatttctcacttctgtggaattctttcatgccaaaatagcctcctgaccaagcgcaacatctctgtacaaatcaattcat

SEQ ID NO: 74668 - DNA, 4559 bp, Homo sapiens
cgcctgcttttgcccgggtcctgagaacaggggctccccacactttgttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcacgctcggggcctgcgctcagagcttggaaaactggagtttcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcaacgtccaacgtggaaaaggcgttacctcttctcccagcgctggccgcctggcactgagggtccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagcgcagtcccgcaatgtcagctcaccgccacctccgccccccgggttcaagcgatgctcctgcctcagcctcccgagtagctgggactacaggcacctgccaccaccacccccgccatattttttgtatttatagtagagacggcgtttcaccgtgttggccaggctcgtctcggaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagccagcccagagagaaactatcttctcccaacatttactaacatccactggtcaactctcttatttccataacacatttgcatctttctggattcaagcttggtggttttctttcctaacttctgatttagatacttctccctcgaggtggggataaaagaaaaaaaaaaacaacttcttttttgcttccgcataacacttcctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagaggagagaggctttcggtggacacgtttgacattaaaaaaaaaaaaaaaaaaaaaaactggtgcctaatttattaaagagaattagcttagcgatgtatattctgatattcttcgacacacgtgggtaagttgatgccatttataaatgttttattgaaatttgatatttaatgagaagccggttaaggaatgtagacaatatcccgtttcaaagctatgaaatgtgctatttattgaaaggggatgtggcttcacgagttcagcccattgtacgtgcaggtcccgtgggaaggaggcaaaagcccctgcttcttactttgtgatgtatgtggatttgttatttatttttttttttccttggtcggacgttcataaatatgtactattttaattatgtcgagtgtaaatttgacatcgcgttgcatttatttttatatttctgaaaactgttgctttttctttttccctcccccattgacgacatagcggcccccggtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaaacaaacaaacaaacaaaaaaaaaaccaaaaaaaaccaccctgagtttctctggtgacgccctcattctcctttcgttcaataactcaatgttgagttgcagcaacagactgtatctttgtgacgccccgtagtatgaatgtacatcttgtaaaactgagatataaataaacttataaatatttgt

SEQ ID NO: 74669 - DNA, 1953 bp, Homo sapiens
cgcctgcttttgcccgggtcctgagaacaggggctccccacactttgttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcacgctcggggcctgcgctcagagcttggaaaactggagtttcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacagatggagttttgctcttgtcgcccaggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaatttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtggat

SEQ ID NO: 74670 - DNA, 378 bp, Homo sapiens
ggccacgtcagcacgtgggagcatctgtggataccgcagagtctggggacagctgggcgtttaaccgaaatgaagccgagacgggtttcaggttttggtgccaagctctggtcaggatgaaagggaaataccagagtcctctgtcctcgcctctgggtttcatgctgacctttctaacatttgttttcccctaagaacaagcagaagcctccagctccctttagctccacagttttcccggggacatagcgaggatggcacacggcagccactcccacgacacacatttcggaggcactttgctggaagccgcttgtctcctccagctttgggaggtctggggaggagagaggctttcggtggacacgtttgacatta

SEQ ID NO: 74671 - DNA, 1231 bp, Homo sapiens
ggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcgttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtgg

SEQ ID NO: 74672 - DNA, 1177 bp, Homo sapiens
ggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcgttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtgg

SEQ ID NO: 74673 - DNA, 3468 bp, Homo sapiens
ggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcgttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtggagatgttttgagcaataatttctgctcatatgtctgaaaagtatacagagataaattctgtgaatacaaagactaagaaaagtcttctgtggaaagatagactttattatcaggtttcatcatagatttcaacgtaagtgagcttattgttgatagaaacatgatgaccatgacaaagtctttactcagaaatatgacctcagtgagtgtcaaagtttacactggaaaataactttaaggtgacagtattgatggcaggatttcagcgacgcactctgcttcatcatttgtcaggagatcacatagaaagtaaaattgttccgaacatgctatcaaataaatgtggaacacctttagcaaactatcaacagctcatgaaggcatgaaatgtgaaaatgatgaatatttgagtgctttttcttaataagtataaccttaaacatcagctaatacacctggtgtgcattttcagtcaggataccttaatcctcatttctagttgccttgccaatgattccataatatactgtctcattactgtttatttttactgttgtgtaaaattgtggtataatgagaaatacatttggtctttgttcctggttcctggcatagagctcctaaaacgcttagaatttcatgagtgataagagttttttggttttgttttgtttttgctgttgttgttattcatagcactgcccttttaattacacctgattatactactgaagtgacttatggttgctcccctagacagcctcagaatggggctgttctctaggaagatcaagtaactagaggatggagactttgtgccccatttctcccacctcctggaaggggaggggtgctggagattagattagacaatgagattaagagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaactaagattatagagatgatcagtttataaaaccaccttcaacttaaataaatttgaactcgaaattgcaaaagcagtctagaggctttgctagtatccttcaaccaatttctagtaaaaatatcctatataaccataattatcaaaaccagaaaaacaacattggtaggatactataaagtaaactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtg

SEQ ID NO: 74674 - DNA, 557 bp, Homo sapiens
cgctcgtgtggcacagcccccaccgactcctatacacatagagatctacactgagtcttttcaacgtggtgcatatcttcttatctagagatacacacagtgtctccaccggacgcgtgggtcgacttagcaaccacctcataggcccacccacctcgggatccgagccaaccatcccacatcacaaactttggtttgggggactttacgttcgtttaatttctcattttgtacggagaaatattcttttcaaaagcgtcttttgactgaagtaactttcctggtgctgttgttaactcgttcctttttttaatttattcccccaccccaggcagccctcctggttcctactcaccctccccccctcccccaccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaacaaaaaaaactc

SEQ ID NO: 74675 - DNA, 484 bp, Homo sapiens
aagcaggctggtctggtctgggaattttaggattgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatgg

SEQ ID NO: 74676 - DNA, 1547 bp, Homo sapiens
  misc_feature (20)..(20): n is a, c, g, or t
tccgctcggacgaggactangtgtgggggagaggggacgatacagggtgtgtgtctgggagtgcctgggggacagggaccccccggtggtcctatggcaggatgagaagggagggacttggctcccccagagcccggtggaagctactgttctctccagtgtctcgagcgtagccaaaataaggttgggaggctcccggcctgtctgctgtggtctgagctggctgcaagcccaggtgggggagcgagtctgggaagattggctttgactctctgttgccagaggagatgccatcccagcacggcccccactgtagtccaggctcgtggtggcagcgggggcaaggggaggggcaaggctgcccccaccccacgcaccaagtcacgccaagtctcagcaggtaaaagcacgtgagcctagggcgagcggagggagtcctggtggccccgcaggtcaggagggaaagcagggctcagagggcatcgtggccccagggcagggtcctacctgggggtcaggagcaccttggtcttgatgattgattgattgatagaatggagctgggtctgagcctcccaggcttgagctcctgggagttcttgtgcggtgagctgggcagctcctgggtaggtccgggcaccaagcaggccctgatgtggacagagtcccatcagagggagctgatgaagaatggtccctgtaagtaagtcactaggttcaacaactgcctggccgagcactcagcccgtggagctcaggccaacaccagagccccggttttaggggccaggagagcaggtgaccaattatttggggagtcttgggtagaatttccgccacacattctccccagggctgcaggggtcttccgaggcagggcggtggagcaggattcaggatgtggtgggaatagagtgaggggcagtgggtgggcagacctgggcgtcagaggtcctgatgggaaaggaggcaggggctacccagagaggggggctcgtgtggcacagcccccaccgactccgccgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgtacggagaaatattcttttcaaaagcgtcttttgactgaagtaactttcctggtgctgttgttaactcgttcctttttttaatttattcccccaccccaggcagccctcctggttcctactcaccctccccccctcccccaccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaacaaaaaaaactc

SEQ ID NO: 74677 - DNA, 1503 bp, Homo sapiens
  misc_feature (20)..(20): n is a, c, g, or t
tccgctcggacgaggactangtgtgggggagaggggacgatacagggtgtgtgtctgggagtgcctgggggacagggaccccccggtggtcctatggcaggatgagaagggagggacttggctcccccagagcccggtggaagctactgttctctccagtgtctcgagcgtagccaaaataaggttgggaggctcccggcctgtctgctgtggtctgagctggctgcaagcccaggtgggggagcgagtctgggaagattggctttgactctctgttgccagaggagatgccatcccagcacggcccccactgtagtccaggctcgtggtggcagcgggggcaaggggaggggcaaggctgcccccaccccacgcaccaagtcacgccaagtctcagcaggtaaaagcacgtgagcctagggcgagcggagggagtcctggtggccccgcaggtcaggagggaaagcagggctcagagggcatcgtggccccagggcagggtcctacctgggggtcaggagcaccttggtcttgatgattgattgattgatagaatggagctgggtctgagcctcccaggcttgagctcctgggagttcttgtgcggtgagctgggcagctcctgggtaggtccgggcaccaagcaggccctgatgtggacagagtcccatcagagggagctgatgaagaatggtccctgtaagtaagtcactaggttcaacaactgcctggccgagcactcagcccgtggagctcaggccaacaccagagccccggttttaggggccaggagagcaggtgaccaattatttggggagtcttgggtagaatttccgccacacattctccccagggctgcaggggtcttccgaggcagggcggtggagcaggattcaggatgtggtgggaatagagtgaggggcagtgggtgggcagacctgggcgtcagaggtcctgatgggaaaggaggcaggggctacccagagaggggggctcgtgtggcacagcccccaccgactccgccgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgtacggagaaatattcttttcaaaagcgtcttttgactgaagtaactttcctggtgctgttgttaactcgttcctttttttaatttattcccccaccccaggcagccctcctggttcctactcaccctccccccctcccccaccctccgtcccatctgaaccatttgtttcttttctttccgtcagattttggaaaaattctgagacggagtcttgctctgttgcccaggctggagtgcagtggtgtgatctctgctcactgcaacctctgcctcccgggttc

SEQ ID NO: 74678 - DNA, 1493 bp, Homo sapiens
  misc_feature (20)..(20): n is a, c, g, or t
tccgctcggacgaggactangtgtgggggagaggggacgatacagggtgtgtgtctgggagtgcctgggggacagggaccccccggtggtcctatggcaggatgagaagggagggacttggctcccccagagcccggtggaagctactgttctctccagtgtctcgagcgtagccaaaataaggttgggaggctcccggcctgtctgctgtggtctgagctggctgcaagcccaggtgggggagcgagtctgggaagattggctttgactctctgttgccagaggagatgccatcccagcacggcccccactgtagtccaggctcgtggtggcagcgggggcaaggggaggggcaaggctgcccccaccccacgcaccaagtcacgccaagtctcagcaggtaaaagcacgtgagcctagggcgagcggagggagtcctggtggccccgcaggtcaggagggaaagcagggctcagagggcatcgtggccccagggcagggtcctacctgggggtcaggagcaccttggtcttgatgattgattgattgatagaatggagctgggtctgagcctcccaggcttgagctcctgggagttcttgtgcggtgagctgggcagctcctgggtaggtccgggcaccaagcaggccctgatgtggacagagtcccatcagagggagctgatgaagaatggtccctgtaagtaagtcactaggttcaacaactgcctggccgagcactcagcccgtggagctcaggccaacaccagagccccggttttaggggccaggagagcaggtgaccaattatttggggagtcttgggtagaatttccgccacacattctccccagggctgcaggggtcttccgaggcagggcggtggagcaggattcaggatgtggtgggaatagagtgaggggcagtgggtgggcagacctgggcgtcagaggtcctgatgggaaaggaggcaggggctacccagagaggggggctcgtgtggcacagcccccaccgactccgccgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgtacggagaaatattcttttcttttttaatttattcccccaccccaggcagccctcctggttcctactcaccctccccccctcccccaccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaacaaaaaaaactc

SEQ ID NO: 74679 - DNA, 1361 bp, Homo sapiens
  misc_feature (20)..(20): n is a, c, g, or t
tccgctcggacgaggactangtgtgggggagaggggacgatacagggtgtgtgtctgggagtgcctgggggacagggaccccccggtggtcctatggcaggatgagaagggagggacttggctcccccagagcccggtggaagctactgttctctccagtgtctcgagcgtagccaaaataaggttgggaggctcccggcctgtctgctgtggtctgagctggctgcaagcccaggtgggggagcgagtctgggaagattggctttgactctctgttgccagaggagatgccatcccagcacggcccccactgtagtccaggctcgtggtggcagcgggggcaaggggaggggcaaggctgcccccaccccacgcaccaagtcacgccaagtctcagcaggtaaaagcacgtgagcctagggcgagcggagggagtcctggtggccccgcaggtcaggagggaaagcagggctcagagggcatcgtggccccagggcagggtcctacctgggggtcaggagcaccttggtcttgatgattgattgattgatagaatggagctgggtctgagcctcccaggcttgagctcctgggagttcttgtgcggtgagctgggcagctcctgggtaggtccgggcaccaagcaggccctgatgtggacagagtcccatcagagggagctgatgaagaatggtccctgtaagtaagtcactaggttcaacaactgcctggccgagcactcagcccgtggagctcaggccaacaccagagccccggttttaggggccaggagagcaggtgaccaattatttggggagtcttgggtagaatttccgccacacattctccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgtacggagaaatattcttttcaaaagcgtcttttgactgaagtaactttcctggtgctgttgttaactcgttcctttttttaatttattcccccaccccaggcagccctcctggttcctactcaccctccccccctcccccaccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaacaaaaaaaactc

SEQ ID NO: 74680 - DNA, 1013 bp, Homo sapiens
agctgtaccgcccggaagtacgggatctgggtctgagcctcccaggcttgagctcctgggagttcttgtgcggtgagctgggcagctcctgggtaggtccgggcaccaagcaggccctgatgtggacagagtcccatcagagggagctgatgaagaatggtccctgtaagtaagtcactaggttcaacaactgcctggccgagcactcagcccgtggagctcaggccaacaccagagccccggttttaggggccaggagagcaggtgaccaattatttggggagtcttgggtagaatttccgccacacattctccccagggctgcaggggtcttccgaggcagggcggtggagcaggattcaggatgtggtgggaatagagtgaggggcagtgggtgggcagacctgggcgtcagaggtcctgatgggaaaggaggcaggggctacccagagaggggggctcgtgtggcacagcccccaccgactccgccgtccccctcccctgtgagccccgggggctgtacatactctactccatccccttgtccatccctgagaccacccccgccgcccttgcgtcgacttagcaaccacctcataggcccacccacctcgggatccgagccaaccatcccacatcacaaactttggtttgggggactttacgttcgtttaatttctcattttgtacggagaaatattcttttcaaaagcgtcttttgactgaagtaactttcctggtgctgttgttaactcgttcctttttttaatttattcccccaccccaggcagccctcctggttcctactcaccctccccccctcccccaccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaacaaaaaaaactc

SEQ ID NO: 74681 - DNA, 2390 bp, Homo sapiens
  misc_feature (120)..(120): n is a, c, g, or t
  misc_feature (260)..(260): n is a, c, g, or t
  misc_feature (298)..(298): n is a, c, g, or t
cgccgcgagctgcccgcgccgcgccccccgcgccgcccgccagccccgctgcgacatggcccgcgccgcccgccggaggccgcgaccccggagcgcggcgcggccggccgctgagcgcanctggaggcgggaggcccggcccggcctcggagcgagcgcccgcgcggcctggccccctcccttgcgctgctccccgcgctccgtgcgcctagccgccgccgcggcccggcccagccagagcatggagacggcggagaagnagtgcgggccctgggcgggctcttccaggccatagtcnacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgggggctgcccacgggcactggcctgccctcggggcgcaccccccgggtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatgg

SEQ ID NO: 74682 - DNA, 1209 bp, Homo sapiens
  misc_feature (120)..(120): n is a, c, g, or t
  misc_feature (260)..(260): n is a, c, g, or t
  misc_feature (298)..(298): n is a, c, g, or t
cgccgcgagctgcccgcgccgcgccccccgcgccgcccgccagccccgctgcgacatggcccgcgccgcccgccggaggccgcgaccccggagcgcggcgcggccggccgctgagcgcanctggaggcgggaggcccggcccggcctcggagcgagcgcccgcgcggcctggccccctcccttgcgctgctccccgcgctccgtgcgcctagccgccgccgcggcccggcccagccagagcatggagacggcggagaagnagtgcgggccctgggcgggctcttccaggccatagtcnacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccacccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaacaaaaaaaactc

SEQ ID NO: 74683 - DNA, 2486 bp, Homo sapiens
  misc_feature (120)..(120): n is a, c, g, or t
  misc_feature (260)..(260): n is a, c, g, or t
  misc_feature (298)..(298): n is a, c, g, or t
cgccgcgagctgcccgcgccgcgccccccgcgccgcccgccagccccgctgcgacatggcccgcgccgcccgccggaggccgcgaccccggagcgcggcgcggccggccgctgagcgcanctggaggcgggaggcccggcccggcctcggagcgagcgcccgcgcggcctggccccctcccttgcgctgctccccgcgctccgtgcgcctagccgccgccgcggcccggcccagccagagcatggagacggcggagaagnagtgcgggccctgggcgggctcttccaggccatagtcnacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagtgcccccagcagcagtagcagtgccaagggtggcggagccccatggcctgggggtgcccaaacatactcacccagttccacctgtcgctaccgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgggggctgcccacgggcactggcctgccctcggggcgcaccccccgggtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatgg

SEQ ID NO: 74684 - DNA, 769 bp, Homo sapiens
aaaacttatggctaggtacgatggctgcggtgttatacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccacccctccgtcccatctgaaccatttgtttcttttctttccgtcagattttggaaaaattctcctctcctccccgccccctccacaccatcctccccgatttaaatatagtcactgctacaagtaacagatgcactgtgaagattccagtattaataaaggtgtactgtaattaacaaaaaaaactc

SEQ ID NO: 74685 - DNA, 1432 bp, Homo sapiens
  misc_feature (120)..(120): n is a, c, g, or t
  misc_feature (260)..(260): n is a, c, g, or t
  misc_feature (298)..(298): n is a, c, g, or t
cgccgcgagctgcccgcgccgcgccccccgcgccgcccgccagccccgctgcgacatggcccgcgccgcccgccggaggccgcgaccccggagcgcggcgcggccggccgctgagcgcanctggaggcgggaggcccggcccggcctcggagcgagcgcccgcgcggcctggccccctcccttgcgctgctccccgcgctccgtgcgcctagccgccgccgcggcccggcccagccagagcatggagacggcggagaagnagtgcgggccctgggcgggctcttccaggccatagtcnacgacatgaagagctcctaccctatctgggaggacttcaactccaaggccacgaagctgcattcccagctgaggaccaccgtgctggctgctgtggccttcctggatgccttccagaaagtggctgacatggctaccaacacccgaggggccacgagggacatcggctcggcgctcacacgcatgtgcatgcgccaccgcagcatcgagaccaagctgcggcagttcaccaacgcactgctggagagcctcatcaacccgctgcaggagcgcatcgaggactggaagaaggcggccaaccagctggacaaggaccacgcgaaagagtacaaacgagcccggcatgagatcaaaaagaagtcgtcggacacgctgaagctgcagaagaaggcgcgcaaagagctacttgggaaaggagacctgcagccccagctggacagtgccctgcaggacgtcaacgacatgtacctgctgctggaggagacggagaagcaggccgtgcgccgggcgctgatcgaggagcggggccgcttctgcaccttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagcctggcgcagccagccaccaccaccgctcgcctctccagcgtttcctcccatgactctggcttcgtctcccaggacgccacctactccaagcccccctcgcctatgccttcagacatcaccagccaggtgagggggcgttaggaggatcagtcagggtggggtgcagcagccttatgccagcatcaggcaagccacatgcgggactactatagctgttgagactactatagctgttgagactggcctgaaggcccccaaggcctttattctgttcagtatttatattattattttctatctctgcttttaaattcacatatctttatatcttaaatgagtctcttgtaagcagcataatgcc

SEQ ID NO: 74686 - DNA, 1616 bp, Homo sapiens
tttattgttggacaacattgtttcacacatacatcaaacaggccaaaaaaaataaacagcaacttcatcaccttcctgcagcctgtggtgaatggagagctgaccatgctgggagagatcacccacctgcagggcatcatcgacgacttggtggtgctgacagcagaaccccacaaactgcctcccgccagcgagcaggtaatcaaagacctaaagggctcggactacagctggtcctaccagaccccaccctcatcacccagcagctccagctcccggaagtccagcatgtgcagcctggcgcagccagccaccaccaccgctcgcctctccagcgtttcctcccatgactctggcttcgtctcccaggacgccacctactccaagcccccctcgcctatgccttcagacatcaccagccagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgggggctgcccacgggcactggcctgccctcggggcgcaccccccgggtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatgg

SEQ ID NO: 74687 - DNA, 1253 bp, Homo sapiens
tcctccttgctgcctgccggcccctctgtctgcaaccgcctgctggcctctgcatggcagaagtcctccagctctgcatcttccgaggcctcggaaacctgccagtccgttagcgagtgcagctcccccacctcggactggtccaaggtcggctcccatgagcagccctcaggcgccactctgcagcggaggaaggaccgagtggagctcctgcgagacacagagccaggccctgccagtgggggcaccctgggccccagcggggaagaggcaccgcgaccccggatgtcccctgccaccatcgcagccaagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgggggctgcccacgggcactggcctgccctcggggcgcaccccccgggtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatgg

SEQ ID NO: 74688 - DNA, 1008 bp, Homo sapiens
gaggagagatacgggagggtgtccagaagccacaagccatggtgtggggaacatcaacgagctgccgagaacatcctgctggagctgttcactgcacgtgcccgcccgccagctgctgctgaactgccgcctggtctgcagcctctggcgggacctcatcgagctcgtgaccctctggaaacgcaagttgctgcgagagggcttcatcactgaggacaccatcccctcccaaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgggggctgcccacgggcactggcctgccctcggggcgcaccccccgggtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtggagaagctgggggagctggtggcgggtgcccacgcactgggtgagggccagttccccttccccactgctctgtcggccacccccacggaggagacgcccaccccacccccagccgccaccagcgaccccccggccgaagacatgctggtggccatccggcgtggggtccggctccgcaggaccgtcaccaacgacaggtcggcgccccgcatcttatgatgg

SEQ ID NO: 74689 - DNA, 429 bp, Homo sapiens
gccaaaccatatcagtctctgagcctcagtttcccccatgtagaatagattattgtgaaaatgagaaaaaataatgtcttttttttttctttttagagactgggtctcactctctcacccaggttggatgatggtggtggtgaggatcacagctcactgcagcctcaagtgagccaggctcaagtgatcctcccacctcagtctcctaagtaggtgggactacaggtgcacaccatcatgcctgcctagaatgtctctgaagcacttaacactgtgcctgacacatagtatttgctcaattaatggtatctgctatcattaacatcatagttattagttattattactaatcgtgaagactgtcctgatggccatttttcactagtttcttccttctaggataaatgggtcattaggcacccacactgt

SEQ ID NO: 74690 - DNA, 447 bp, Homo sapiens
aaggttccaatttctccaaatcttcaccaacacttgttattttctgtttgattttatgatagccaccctaatggatgtgaggtggtatcttattgtggtttggtttgtatttctctaatggataatgatattgtgcatcttttcatgtgcttgctggccatttgtacatcatctttggaaaaatgtctattaaagtccctttctattttctttgcagaaaaaaattttatttataaaagtacagtttcagggctgggcacagtggctcactcctgtaatcccaacactttggaaggctgaggcaggcagatacctgaggtcaggagtttgagaccagctggccaacatggcgaaacaccatctctactacaaatacaaaaattagccaggtgtggtagcgggcgtctgtagtcccagctacttgggaggctgaggcaggcagatcac

SEQ ID NO: 74691 - DNA, 316 bp, Homo sapiens
gtagagatgggatttctccatgtttgtcaggctggtctcgaactcccgacctcaggtgatccacccacctcagcctcccaaagtgctgggattacaggcatgagccaccacgcccagcctagactgaacttcttgagagcagtcggggctgtgtttgtcctttgaataatttttttctgttgaatgaacgtatatgcatcagtaaatcccctacccaaagtaggctatcagaatgtttacagaattgagttttaaaaactgaaatatagtaaatggtttggaaatttaggaaaggtggatataatttcttattaat

SEQ ID NO: 74692 - DNA, 361 bp, Homo sapiens
ggtctcactatgttgcccaggctggtctcaaactcctgttctcaagcgatcctcctgcctcagcctaccaaagtgctgaggttacaggcgtgagccactgcacctggctaggaaactgagttttttcagtggtagaggctcctagccagtggccaagggaaagagagagttctgggttcaggggctggcaggaagtcagcaagacaccagggactcggctccactggctggatctcagggaagagcaactgccacagtggggacctggaacacaaagggaaactgaggcagcagctgcaccacagtttacaagtagaaagaccatgcttgaggacaacagaagtttcactaaggatgcacg

SEQ ID NO: 74693 - DNA, 696 bp, Homo sapiens
gatgatttgattctaagtcccaggaaggaaccctcttccaggaactcaccatcaactctcccccttttctccttccagctggcccaacctggacctgtcggaaacttctccttcaccactatgccccagggtcccaaatgccccaggatcccaaaaagattgccacctctgacctttgaaaatatgagcatgtgagcttgaggcagcaggagaagaggaagtgggctttgactgatttacaattcagggaactaactcttgcccatagcttctagtgtggttctttccaagagccagactaccacttttgctcctctctttttctcatttcaggaccctcttccaatccatctataccctgtccggtttatgttagtgacaaaacaagactcccccatccttcaaggaggtggagcatcagaatcttttcagaataggggtggagaggaaaggattcagttgtggtgccctcatttgtgagactcgagcccttgttcaaaatcatcttctcagataaatccccaccagatctgcccagaaagtttatcagaccctccatggcccatgtcattttggttccaaatgtttcaggtgacttttgaattgcaactgaaaaagttattctgatttttgacattatagagttcattatcgacagctggctataaattactaaatttataattaactatataa

SEQ ID NO: 74694 - DNA, 526 bp, Homo sapiens
cgcgcctagctggcgggaccgttagatcgaggcggatgcggcccggaccccgtggatatggagcaatcgccgccgctggcgccggagcccacccaagggccaaccaccacaaggagctgaaggcggcgggagcccgagtcgccgccggcgtcggtgccgtcaaagaagatggccagggagacagcagcatggtcagagtggtaggagctggccatcggtgagagctgctccatgcctggctgctgggtgctagagcttgtggaccactggcttgcctcactgtggttggtggtggcggtgacagagtgtgccctcacccctgggcgccgtggacctgtacgagtatgcatgcggggatgaggacctggagccactgtgacgccacccatgagaacgccgctgcggggccgctccacacgtgccacggccaccactgggacaccgccgcttgtgtaaaaactgttgtcttttgtggaaaatgagtgtgtttgcatggaatgataaatttttatttattcacaaaaaa

SEQ ID NO: 74695 - DNA, 459 bp, Homo sapiens
cgcgcctagctggcgggaccgttagatcgaggcggatgcggcccggaccccgtggatatggagcaatcgccgccgctggcgccggagcccacccaagggccaaccaccacaaggagctgaaggcggcgggagcccgagtcgccgccggcgtcggtgccggcttttctggctttgcccgcccagctgctccatgccaggaggaggaggagacacctagagcctgcgacaccatggctcgcctcgctgcagtgtaggttctacccatgtaacagatgaggaaaccaaggagcacagttatttactaactcgcacaagagcctttcctgaggaaattttttttttggtggagagactgagaacacgaggtgcacagtgaccagctaaagggagaatgaggcagttccaaaatgaattataaagtatacgagtattaaagtctacttgttttttattgctaaa

SEQ ID NO: 74696 - DNA, 626 bp, Homo sapiens
cgcgcctagctggcgggaccgttagatcgaggcggatgcggcccggaccccgtggatatggagcaatcgccgccgctggcgccggagcccacccaagggccaaccaccacaaggagctgaaggcggcgggagcccgagtcgccgccggcgtcggtgccgtcaaagaagatggccagggagacagcagcatggtcagagtggtaggagctggccatcggtgagagctgctccatgcctggctgctgggtgctagagcttgtggaccactggcttgcctcactgtggttggtggtggcggtgacagagtgtgcagcacgaccagagtggcttttctggctttgcccgcccagctgctccatgccaggaggaggaggagacacctagagcctgcgacaccatggctcgcctcgctgcagtgtaggttctacccatgtaacagatgaggaaaccaaggagcacagttatttactaactcgcacaagagcctttcctgaggaaattttttttttggtggagagactgagaacacgaggtgcacagtgaccagctaaagggagaatgaggcagttccaaaatgaattataaagtatacgagtattaaagtctacttgttttttattgctaaa

SEQ ID NO: 74697 - DNA, 705 bp, Homo sapiens
cgcgcctagctggcgggaccgttagatcgaggcggatgcggcccggaccccgtggatatggagcaatcgccgccgctggcgccggagcccacccaagggccaaccaccacaaggagctgaaggcggcgggagcccgagtcgccgccggcgtcggtgccgtcaaagaagatggccagggagacagcagcatggtcagagtggtaggagctggccatcggtgagagctgctccatgcctggctgctgggtgctagagcttgtggaccactggcttgcctcactgtggttggtggtggcggtgacagagtgtgcagcacgaccagagtggcttttctggctttgcccgcccagctgctccatgccaggaggaggaggagacacctagagcctgcgacaccatggctcgcctcgctgcagtgtaggttctacccatgtaacagatgaggaaaccaaggagcacagttatttactaactcgcacaaggcaagtttcaaaattgtctttgaaaataatgattgcttttaaggtttattctataatggtttaagatcatgggttacagaagtagaacaacagtgtctaattactagttctaataattcttatcggatttgttgagattttatacacatacatgtttgtttttgtgtataagtatatatgtaacaatgtattacacatatgaattaactgtttaatatgtgtg

SEQ ID NO: 74698 - DNA, 780 bp, Homo sapiens
cgcgcctagctggcgggaccgttagatcgaggcggatgcggcccggaccccgtggatatggagcaatcgccgccgctggcgccggagcccacccaagggccaaccaccacaaggagctgaaggcggcgggagcccgagtcgccgccggcgtcggtgccgtcaaagaagatggccagggagacagcagcatggtcagagtggtaggagctggccatcggtgagagctgctccatgcctggctgctgggtgctagagcttgtggaccactggcttgcctcactgtggttggtggtggcggtgacagagtgtgcagcacgaccagagtggcttttctggctttgcccgcccagctgctccatgccaggaggaggaggagacacctagagcctgcgacaccatggctcgcctcgctgcagtgtaggttctacccatgtaacagatgaggaaaccaaggagcacagttatttactaactcgcacaaggttcgaggccgagctcagacctgtggagcagaagctgagtgcgctgcagtccccgctggcccagaggcccttcttcgaggtgccctcacccctgggcgccgtggacctgtacgagtatgcatgcggggatgaggacctggagccactgtgacgccacccatgagaacgccgctgcggggccgctccacacgtgccacggccaccactgggacaccgccgcttgtgtaaaaactgttgtcttttgtggaaaatgagtgtgtttgcatggaatgataaatttttatttattcacaaaaaa

SEQ ID NO: 74699 - DNA, 739 bp, Homo sapiens
agggccagccagcctgtactctgggcaagagccaaaaatggctaggaatgtttgactcccttaatctcttccccagctacagaggaatcttttctctgcctggtctcagaatgggactgccaactggctcattggtgggagacacagtatcctcaaacctgtggccactggcatgacagtggtgctctgtctccctgggtgacacccaccctaggcttcctcctggatgtgatggggattgccagagaggctcttagcataaaaggcattaggtgggcatttttctgtgtgccccccaaaaagctccatggaaacaggcacctggtagctgcggaacacccgtggacttgtgtatatggtcataggctttgggaagacaggacgtaaaggaaaatgagagaaacaaaatgggtcagatagctttggccacagccccaggcagcctttggggcctatgacacttagtgcccttagatgggatacatcttgcctcggccccaagactcctccaacttacccgtcccatccagggcctgcacagcttagagaggctcacagcttggcaaatgctagggcttcatcagaccactgacttgactcagtgtttgttaaaatggaaccactcccgttggcctactgtttctctcctgtacttcttgtaatgatagttatttattgactctggtagcaggcagttcttaaataaagatggtttctcaacctgttggggaagctggca

SEQ ID NO: 74700 - DNA, 622 bp, Homo sapiens
catgtcttggtaaatgacagatataaaagcccggcttttctcactgtcccactcccacccatgtcctgttagtcaaggagctctgacttttacttttgaaagtatctccaaatctccgatacgtcctccattcccattgccagtaccttaactcagaccttcatcatctctaggctagattgattgtccctgttcaccagcccatcatccccagtacaccaaagtcattttcttacatgcagagccactgtcccatgttccagaccctctctgctgccctcaggcttcactttggccaaccttcgttagctaagcctttgctaacctcacaccactcctcctcttactggggtttttgtgccagattgtcatgcagtagaactttctctccctgagcctggaccaccaagtgacctgtgcctggtggtgactaatttgttatatatctactgcatgtcatgcacgtgctaactgctcttgtgccttttctaatttaaccgtgacagcaacttgctgaggcataggtgctatactagctcccttccacagactaggagattgaggctttcaaatggaaacgatttgccaaagctgcatctctagcagcaagatgcaaactcag

SEQ ID NO: 74701 - DNA, 243 bp, Homo sapiens
aactttttatttttggcactaaatatcatttataagagctagtccccaaagtagaaaatctactatagtatgtaaaccagaactcttaggaaatgaatttccagattgggcagctgaatgagtaaggcagactgaataacacagaagacagtatctgcctgtatactacctaaaaattcttaagagtgtccttcctgccctataagcttaaatccaagtcaagaagatagtggtgcttagatc

SEQ ID NO: 74702 - DNA, 642 bp, Homo sapiens
cgtggtttacagaaaataaattacatgaactgaatattttgcactattgtagaagataaattgatctaattattatctaacttcaaacacagtggaataaacagattatcatatctatgctgacatattagagacaagatttatttgcttttgttttgtagaagatgcattttcctttttggaatcagaatgatacacaaaacgaattaaccctgagcatcccacctgctcgactgtacctctattcctcaatattctcagggtcaggaaagtgaatgcagaaggtttcgcaaagtaaagccccacaggatcacagaagcaagaagggagtctacagggaattctgtggaacccaggaaacggcccacacatgacccaccaccccctgcaatggcaggtattctgtggaaccctacagggacccaggaaaaggccacacatgacccaccagccctgcaatggcagggattctgtggaacctacagggattctgtggaacccaggaaatggccacatgtgaaccaccatcccctgcaagggcagggattctgtgcaacccaggaaaaggctacacatgacccaccacccctgcaatggtgcattcacttgcaggggatggagaaggtggagatggttcatcat

SEQ ID NO: 74703 - DNA, 591 bp, Homo sapiens
cccgagaaactaaatcaacattcacctggggatacctgtactgggtaggcctgtgatgggcaataagaaaagtcacttatgttgttctctcaggaaactctgagcaggtaaaaggttggcagaggctaccggtgcacttccaatattagtgatggagtcctgctcagaatacacaccatgcttctcaggctttcctgcaaccgggcgaagcacagttctggcccatgagatatttgcagaaatgatgtgtgtaacttctggaatgtaccatgatgaggaatggacataccccaccaccaccaccaccccaccccacttccccttccctattacttagcagctgcaatctatacctggtggtaagtggtaatgagtgaccctcaaccactccaatgagcacaatgccttagagataggtgagtaacaatatagaagggtcctgagtccctcgcaccacagacccattattccagttctgtaatgcttatgcttgggcagtcacataactgaaaaacaaactcttgttttattgaagtcacaggtactttgggtcttggtcttaatagcagaatctacttcttaattaattaa

SEQ ID NO: 74704 - DNA, 203 bp, Homo sapiens
tgaacatgggggtgcagatatctcttcaagatactgattttatttccttaggacatatacccagtagtgagattgctggatcatatggtagttctatttttaattttttgaggaacctccatactattttctataatggctgtaccaatttacattctggtggtagattttttaaacagccatcaagatgacattttcttttc

SEQ ID NO: 74705 - DNA, 488 bp, Homo sapiens
acacagtgctgggtctacaaaacactttctaggggaatgactcggtgcagttctaggggaagacacagcccctccgcagacctgctcagcctcgaaccctgcgctgatatgccctttggttgacaccttcctctcccacctagtgtggtcttcttgtgctctgttctggagtggccgagctgaaaggatgacactgccttccctcagcacatatgagcacaggatatcccatatcttctgctccatttcttgagaaaacagaacccaaaagagttgccatgaagagcatttgagtggcccaggaccctggccttgctttctgcagcctcctctggtttactcaggccacagccatataggccccattcacattcaaggctacgctgattctgtgtccctgggacttgtccagaagtatttgtgaaacttgtagtcagttctctttcctttccttttctttctggttgaaataattgcacaatgaggca

SEQ ID NO: 74706 - DNA, 1094 bp, Homo sapiens
aaaactcatatctgaaaacagattttaggaagcctatgatcagggtttctctcaaccatgtttgttttttaaacagggtcccctcttgtcacccaagctgggggtacggtggtggcacagtaatggcttgctgcagcctcgtcctctcaggctccagggatcctctcacctcagcctcccaagaagctagggctgcaggcacgtgacactgtgcctggctaatttttcctatttttgtagagaccgagtttcattgtgttacccagctggtctcgaactcctgggctcaagtgaccctcccacctcagccttccagatttgctgggattacaggcgtgagccactgcgcccggccgggatctgattttatataacctataagattatttgtcctgtttatgcaagatttgttatatatttgtcacttgatgctttaaggcgctctaaatacttaggctcggaaatcaaatttcatctaccacttactagctatataacattaggcaagttatttgacctcttagtgccttactttctcatctgtaaaataagagtaataaaagtatcttacagtttgggctttagcatgtaattgctaggtgaggcagtggcctcttgccatatattttggaaaacttcacttagccctgtctgcatgattcaaggttagaatgataattggttttactgacatattaactcctttaagaaaggaagggaactaggtttccttgacaaactactctgcccagacactgtgctctcttgtatatctttgtattaaattgttatgacaaccgtatggtaagcttctctgataaattgccccaaaactctgaagtcacaagatgaaagttttctatgttggctaagagcctttaggggcaaaaacttaagaatctagttagaaagaaaaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctca

SEQ ID NO: 74707 - DNA, 500 bp, Homo sapiens
ttttaatggaaaaggacctgctgtggtttatagtttttctacttaccttacgtccaggaggtcctggttccccaggggatcccatctctcctggaagcccagcagatatctcaaaggagaatttattttaaaattgtatttatacatatatgtatgtgtgtgtgtaaattcaaattttaaaaaattaaaattcaaaggtgaaaattcaaaagtgaaaatttcacttttattttagaaaattgagagttttccaaaaaacataaagaaggaaaaaatattcccagcaatcccttcttccccaaataatcctcattaacattttgatgtcttttcttattttttttggaattaagacatatattcctttttaaaactcatttgaatcatacttttctctgttaccttttaaactaaatatatctctggacattttcagttagtaaacattatttggcaaaatcatttttcacagctgcatagtatcccatcacatggttgta

SEQ ID NO: 74708 - DNA, 4393 bp, Homo sapiens
  misc_feature (733)..(733): n is a, c, g, or t
  misc_feature (1009)..(1009): n is a, c, g, or t
  misc_feature (1586)..(1586): n is a, c, g, or t
  misc_feature (2096)..(2096): n is a, c, g, or t
  misc_feature (2790)..(2790): n is a, c, g, or t
  misc_feature (3284)..(3284): n is a, c, g, or t
  misc_feature (3571)..(3571): n is a, c, g, or t
  misc_feature (3896)..(3897): n is a, c, g, or t
tctatgaataggagaggctcaaaaagaggcagggaccaacatggtcaaatacaaagactttagaacacagtgagcattgaagaaaacaagatagcagcttcaccagtgcaagaaagcagaacagaagctgcctttcaagggattacagtgagagggtttggtgtaagaattcaggttcaaagtacagtatccttatataataattcagaaaacacacatggaccataaaatgaaattgattttggccaaatcattcaaactttatggactttgttgtttatccagttctgtgctaagatttatattatggcacgtctttaaaataatgaggtggggggaccagtaaggtggcttcaactcactaaaagaaaatatattgtttcattgtcatctattttgctaatatttgtgttcaatttagagaaagtagggtagacatagtggtaaacagttctcttactcttgaattgacaagtagactgagaatttcacaaaaggcttttcctcactttgagtgtttttattctttaattttcaaaatgctatttcactgaattgagacagtttggtttttatttctgaattactttctgatattattattactgaggtagtttagctagttgtggccagttgttttggtgctcagtgtagttagaatacagattgcattatacacaaataacaatttatcacatgccaaatgtgctctgtgaatctgaaaagctccctntatatgagggtatatttccctcaagccaggcaattttaaggacctgcaagctcccaccaccaactagctcagtgtagtaaaagttaatttagtaaacacatcatcatcctaagtaatcctttccttgactaaaataccctctgcttggcagagaagcaattggatcaactacatcaggactccaagtgatcccaccctgattccaacacccccatgttgttcttgtttccttggaggccttgaaaactgtgcatgcacagcaaccggattcatgtngagccattccaattcatctgagaagcgattctccacttaggcatcaacccatgaccatcacagggtgtgtgcacatgtcctgggtttatcaggtctaactatatctttcagaatactgattccagaactcttaggtaacgcagagatcagttgaacttaatgtataaatgtgcattttatatataaaatattgctcttcaaaatttggcttaaatcatgctttcttgtgtgcctttgaacaaagattttgatttaaaaaatcattgagaaatgtaattcaagaatgcccagaaattgtcattagtatttgttaagttgtttatgaagaacttaagcccactttaatttctgtttttatatagatcttccccaagacaaaacatcttttattgacttccttgaaaacaatttagtactagagatcagcaataacttattagacagaaaccagattatttaatcatttggctttcgaaataatatttagattgaaaaaagcaaattagaagagtttactaaaggaactaatgactgtcatctcatactcttcttttacattttaaactttttaagaaantgatctttcatcatgtcagtgaaactttagtttccctgaagtttcacagtcatttacaaggttgaatttttttatatgatgaaataatagtatttttaaaatattaataatattacatggccataattgtaaagtcagtgataacacattttatgacaaggtgtgcactgcattatttcatagtacattcataatcaaaggtcatgttggacatacaacattaccataattttctaattaatttgttctttatacatgtttatacgtgttccaattgcatttcattaattcatagttttcttgtaagtttgtgctttccttccatgttcaaagaatctctttaattcaatttctctgtttctcctcatacagtctggcagccagatatgcaactcagtctaatcacagtggaattgcaaccagtcaaaaaaagcctactaggtcagttaatattctctaatttattgcttattagtgatatgcaaataaatacccagtgatattttgtcntatcttttttttttaatgatgcacttctgaatgagaagtttagagcactaaatttttccaggaagattttcacacatagcctcagggatgagcatgtttgtactagataattaaatgggttttggcatcttttttagttttgtgatatgtagtgctataactgggcttaagtctaggttctaggtttagaatcaatcaaggaaaccattactttgaatgcccaattccttccaagtcacataatctggaagttatacaacaaaattgtaattgctttttgagatgggcatgcattaattattgcacattttaatggagatttgaaaaacattggcagattttagtggggaagttagtaccaggtcagtctggactgttcttctatctataatagtttaatttttttgcttctttatgacacaggtataataaagacagcctgttatagtaaatgatagtgcgttatatactgtttggaaaataatgacctataaaaatgttttgaaagagtttgattttttaaaagtgttaagttgctgaaggcatgatggtagcatggaacagctgaataaaaccacagcaaaagagttttatacctctgattagtatgtgatcctttgtgtcatctcactcactggggaagtatccagcagtggtttattcattactgttccattgatgaatcatattatgnagtgtttgaccacaaagactgcgtctgatgctttgacttgaggtaggtgtctttccccttgccttggctttctaagttatattcatttccagagtagccaaaataattctcgaaagacaaattttaaaaggtatttaattaaaaactagaataaatgatataaattatgatgggtaaggaacagtcacctgccatgcacaatgagcatttttattactccttctaagacttgggcatgtaaaatatttttaagtactgtattttgatagatctctctccctctctctctctcctctctgcttcatctcatttccctttttattactttgatgaataatctgaaggcctgctctgcctgcctgtcaaattagggtaatgagaagagcaaatgtatttttacatttgttttaatttgttcttctaaggactgaagatcatttgacttcatgggttgcagtaaagattaaaatgtattttaattattttctgaaacnggtcaatttgcattacaagcagggcaagttttgtgataaaatttgtttatgtgtgtgagtttggaatgaactttctaagtctatgcctatgtctacagaaatagttctcagatttattatgattaggacacttggccaaattcattagttgggttccttcaacagagtgcaatcactggtcctgtaaattcctagcatctgtcgttattatgctgtacttacaaacccttgtagattctcttaagcaaaagttaaatgctggaatcatttggaaaatattctaatantttgtatgacacaatgtccaattagcaaaatagctaaagggaccaattatcagccatatatatttaaacattaaaatataattcacattttgaagctattaaccgttctaagaaatcaacagttttgtttttaagttagtatttgttttttttcctgatattcactctattttataatgactgttactattataaaagcacttatatttcctgaaggtggtttgattttctaatattctgtgaaaatgatatagtctagtagtattataaaggtgaattaaatgttgagcatgtaacaactggattgtgaaattttggtatatcnnatactaatatgagagacattaataatctttgctttaaaattttataagatgattataaaaaatagtgctatatttgtagattttgaattcttgttttcctttcaaataaaaaatttcagagtagtacacagtgacattcacatggtggcagcaaatactaaacaaaactttcaatatcatattttctaaatagatcttagactgtcagtattagttcttggccagacacggtggctcacgcctgtaatcccaacactttgggaggctgaggtgggatcacttgaggtcaggagttcaagaccagcctagccaacacagggaaaccccgtctctatcaaaatacaaagatgagccgggcatgatagcaagtgcctgtaattgtagctactcagaggctgaggcaggagaatcgcttgaaccctggaggcaaaggttgcagtgggctgagattgtgccactgcactctagcctgggcgacagagtgacaccctgtctc

SEQ ID NO: 74709 - DNA, 373 bp, Homo sapiens
ccatgttggccaggtctcgaactcctggcatcaggtgatccgcccgtttcagcctcccaaagtgctgggattacaggcttgagccaccaggcctggcccgttactattgttatttttaaatgcattagtaaaaaaaaaaaaaattttaattgctagaacattaaatatcaatacccacattaataaaagctatttgggagccttaataattatcaatggtgtaaaggggtcctgagaccaaaaagtttgacttcaccaggtgtttgaacactacagatcccatcttgcccatgaagcttccctagacatccccaccccaccgtgctcccttctgcatcctacaatagcatccactggtaaggccactatttta

SEQ ID NO: 74710 - DNA, 148 bp, Homo sapiens
ataatgcgcttactgaggagggaatgtgggtggagcaaggaacaagagctgaaacccaagcactgtgacatttatagatgggagagagaaggagggccccacaaaggagacctgaaaagaagcagccagtgagatggaaagaagacca

SEQ ID NO: 74711 - DNA, 456 bp, Homo sapiens
atagctgggactagaggcatatgccaccatgtccggctaatttttaaatttttagtagagatggggtttcaccatattggccaggctggtctcaaactcctgacctcgtggtctgcccatcttggcctcccaaagtgctgggattacaggcgtgaaccaccgcgcccagccgctataacttttaacaattcccatatgtcctttattccactaagatgagtgcagtatatatttccatctgtccaaggcttcctaaatgtagccaaggccaagccaacaccagtcacatgatcaaaatcaaagggcatttggggaatccaggctgtgattcagggaagttccaagtgtctgatgaagtgtttgttttacatctttgtgtcccttgcaggtctagcactgtgctatgtaggtaacatgtgctccattaaatgtgaattaaactaagttttctacaaa

SEQ ID NO: 74712 - DNA, 241 bp, Homo sapiens
acaacaacaacaacaaaaaacactttattgaaaggcattaaagaagatgtaaataaatgatgtaaatcaattaactgcaactcaatggcataaaaacgacaatattcccaaagttcaaatatagattcaccacaacttgaaaacaaaagtccagtatgtggaatttggtgaactgactagaatttaagccatgacattcctgaaaaagaatggctaggtgtaagtacttcatctacaagat

SEQ ID NO: 74713 - DNA, 533 bp, Homo sapiens
atgggtggagaattctatgttaaaataattttccttaaggaatttttaatcaggtccattttttcctcggctgtaggattcaagaatttgaattcaaagagagatgggattcgcatctctatttcttcacttccttctgcacatgccctgaacttcacttgcagatttgataatgtccttctcctcggcatgcttccactgctgcctcttcaacatttcttctcttacttctgccaagatagagcttatgttttatatggggaaaaaaacagatttttttttcagaattttatagctattagcccactgtctttctgctttcagtattctattcaaaacgcccaaagccattttgaggcctaaaacatttcatttccctagaattttgctgaaagccagtgatctgacgttttactgtgatgtggactatggtgaacctaattttttccattgttttataaacttactgtgtgacttcaacatgaaaattcatgtctttcaattataaaatattttcaatttttctgcatttc

SEQ ID NO: 74714 - DNA, 244 bp, Homo sapiens
aaatagcctctaatttcctaaaacactctaaactttagttgaaatgcaagcatactctaccttttaagcacttaatatctagtaagtttaaattttctgagctaagacatttccctacacttttacattaatttaaatactcctaaaacaaagtagctcaaaaagttcacaagtaaactatttcctccagtctcatttttgtttcatacgctgtaatcaaacacagatcaaaattacaacactg

SEQ ID NO: 74715 - DNA, 2853 bp, Homo sapiens
gttcgccagggtcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacgctctgctttcaacactcttggccctttctcaagagaacatgaaaatgaaaaaatttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttggggaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaggtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaattcaaaggttatgccaaatgtgcctcccttttaaaataatgaaacaaacattgtttaagttaaattgttacttggttcctccccacagtgttacttgatagtgtatgttacgaggtgtgaggatctgaccttcatttcaaatcaataccattgtttgatagttgagtaagttacagtttctcaatttatggtgtattttcagatttggcagattttttgttgtctgctaactccatagtcttctagtagtggactgtatacctttatctgcaaaggtgacaactcaggagaactaaccattgtactctatgcacccatggtaattataccccaggtgagcattttgtaaagctgagccagtgaaagcccttcctaagacctttctaa

SEQ ID NO: 74716 - DNA, 1854 bp, Homo sapiens
gaatgtgacaaagcttttaaccgatccttaaaacttactgcacataagaaaattctaatggaagagaaaccctacaaatgtaaagaatgtggcaaagcttttaacctatcctcaacccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaggtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaattcaaaggttatgccaaatgtgcctcccttttaaaataatgaaacaaacattgtttaagttaaattgttacttggttcctccccacagtgttacttgatagtgtatgttacgaggtgtgaggatctgaccttcatttcaaatcaataccattgtttgatagttgagtaagttacagtttctcaatttatggtgtattttcagatttggcagattttttgttgtctgctaactccatagtcttctagtagtggactgtatacctttatctgcaaaggtgacaactcaggagaactaaccattgtactctatgcacccatggtaattataccccaggtgagcattttgtaaagctgagccagtgaaagcccttcctaagacctttctaa

SEQ ID NO: 74717 - DNA, 3875 bp, Homo sapiens
gttcgccagggtcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacggtggggccgggcggagcgggcctcgggtctgcggagggtggacgcgcgctctccctgtctttggagggagggtttcctgtggtcgggaggcgaggcagccagggcaggattgggctcctgacctgcaggccacgggcgagctctctctagggccctgatttgcccgaagaaggcgcttggtgaaggtgaaaggtttacgcatccaagtagctagaacctctttccagaacttctgctgatgcacttagtcttgcagccattgattattatagctcagcaaagttcagttcaactttcggaagaaggatgtgagctggaatgggcagggtcaagatttgacaggaaaagacacttcactggaggtatctgcgagagtcctgggttggagggaaggagtactggttataaataaggaaatgatgtcttcatcacttcctaaacacatacatgtcattccctaccatctccaccctctgtttattcagagctgcaccaaccatgttcatcacctcacctgggatttactgagtttaccccttacagagctacacgataggggtaaaggaaagactaaaaaccaatttatcttatattaaaattacgacttagtaaatatttttttcagtaatgcagtttgctagtgacagatccaataactgaattctggtcctttgagtaccaggtcagggcttttgtcatctaccacatttacgttacctaccacaagaagtttcttagtaaaaggtcctcttgtgaaactgcagctaagggaaaccaaactgtcaaaaagacaaacaccttaaagcactttcattcattctctctggattctgtcatctcaagtggctaaacacattagtaggaaaacagctctgctttcaacactcttggccctttctcaagagaacatgaaaatgaaaaaatttcagagatggggttttgccgtgttgcccagactgatcttgagcttctgagctccagcgatcagcctacctcaacctctcagagtgctgggattataggtgtgcgccaccacacctggccatgtgtgttttcttacatctcctttcttacataaaagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttggggaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaggtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaattcaaaggttatgccaaatgtgcctcccttttaaaataatgaaacaaacattgtttaagttaaattgttacttggttcctccccacagtgttacttgatagtgtatgttacgaggtgtgaggatctgaccttcatttcaaatcaataccattgtttgatagttgagtaagttacagtttctcaatttatggtgtattttcagatttggcagattttttgttgtctgctaactccatagtcttctagtagtggactgtatacctttatctgcaaaggtgacaactcaggagaactaaccattgtactctatgcacccatggtaattataccccaggtgagcattttgtaaagctgagccagtgaaagcccttcctaagacctttctaa

SEQ ID NO: 74718 - DNA, 2915 bp, Homo sapiens
tgtcagaatgtatgctcctaaagagtaagattagtattttatgtgattagtaatccaggcaattggaatagctccaggacatggtataagctcagcacatttttaaaattcattttaaaaaatgaacacagtgacagatttttaattttctgccctcccacaattacatctctctatagctttccattagccatggcagtggtcttcttatagtttatgttaccatacatttgatatcactcaattttggtcacccaagattaaacattttctttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttggggaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaggtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaattcaaaggttatgccaaatgtgcctcccttttaaaataatgaaacaaacattgtttaagttaaattgttacttggttcctccccacagtgttacttgatagtgtatgttacgaggtgtgaggatctgaccttcatttcaaatcaataccattgtttgatagttgagtaagttacagtttctcaatttatggtgtattttcagatttggcagattttttgttgtctgctaactccatagtcttctagtagtggactgtatacctttatctgcaaaggtgacaactcaggagaactaaccattgtactctatgcacccatggtaattataccccaggtgagcattttgtaaagctgagccagtgaaagcccttcctaagacctttctaa

SEQ ID NO: 74719 - DNA, 242 bp, Homo sapiens
gtcttcccttttatttatccatactcaaagttaccaattggttccaaaagtgaacaattataggtaacacattttgagttcttgctgtctgctccatgttaaggactttacatagattagattatttatagctcacaacacttagagagtattttatagatgaaattgaggccgggcgcggtggctcacgcctgtaatcccagcactttgggaggccgaggagggtggatcacctgagatca

SEQ ID NO: 74720 - DNA, 449 bp, Homo sapiens
aggataaacatggactttgatacatctttcctaatttccttctcgtaattttcagttagaacttgaaacatgtgattaggtcaggaccagcttaaagctgaagggggccgtaaaaagtcctttcaggctgtcattttcaagatgaagatcgaagggcccagagctctagaacccgttagtgatgagtcaggacttgaagcccgaggtccgaacttcccccagtcacctgtcaccacgcggtctgtggacatgcctcctctctgagctacttccctgtgtgaaacggtgccagcctgcgttttacatagaaaagctgtaggaaccacattaaaagcatgtcattccaaatcttggttcaattttctaaaatatgaatggaagtaatatttttgccatttaaaaaataatacgatctgtgaaaataaatattgtattttcatattgggtag

SEQ ID NO: 74721 - DNA, 429 bp, Homo sapiens
aaacatgaaatctttccttgccctggtcctttaagaaaaagcattcatcccttgtgttgaccctttcctaaaaagtttgtttatgcaacctgcaaaagagtggaaggcagctcacacgcagacatgcagacgtgaatggagagatggtcacgagtgtgaccccagctctatcccagttgagtgcttaaagagcttttctctgggcaactgcttctctagcaccccataattagcctggtctctgaattgcatatagattgagtggctgggggaagaggagcaagagaatagctctagaagcaaataaaaattatgcagctgtctctagcaagaaaaagagagaatcaccaacagaaaattgggaaagaactgtgaccatacacagctttaaattctctttcacaaatctcatagattgagcaaaaaaaa

SEQ ID NO: 74722 - DNA, 273 bp, Homo sapiens
catgatagatacttccttaaatttttagttcatgtaagtgacatttatggttctgtgatgttccttgcttttcccgtatgcatcatcatgctttaatatccatcgctgccactcgtgtgcattcagtctgtttttcctccttactgcagagtgcttcgttttagccagccaccctcctggagaaggtatccaggctgcctctaactccacaacaacactgaatgcatagtctcaaacgtgttgccttacggcgctgtgtggagatttctctgg

SEQ ID NO: 74723 - DNA, 162 bp, Homo sapiens
agaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcaggg

SEQ ID NO: 74724 - DNA, 1040 bp, Homo sapiens
tctggggaaggagggggagctggcagcaagggacactgcttagagccagtcctttggggatccacaagaccacaaccatcccctgtgccccctccccacgcctcccatgtctagaactttgggtcctaaggctctagcccacaagtcccctagaaaaacagtcttggccctgggtccccctgagcaaaatccctcccaaactgccctaatacccaaggacctctcattccctcttagggaccccctctcctgacccagcccactagaaacagaaactcaaacccagatgcaactcctagctccatcatttaggagctgtacaaccttgggcaagtaataaccttgctaagcctctgtttattcatctgtaaaaagggtctaataatgccttctttagagaattgctggaggctgtcattaatgagacatttatgtaaactgcttagtaggtgactaataagtgcaagcctcttccctcagggcctttgctacacaaaggcattggcaccatttgctcagtctcaggatcctggcctccaatctgagactgtgctccagaacttctcccacagacattttctctctacaacccccacctctcctccatcacaccacaggaaaggccttagtcccaggacacctcccctcttccctcacatacacacaccctgttccaagatccctttaccctcctttctttctgtctgtcttttcctgttatctagtcgctggcctctcctctgctatgcatacatttttttctctcggggacctgaactggggtgggggagaaaagtcaacatgagatagggagaaaacaaggttcagatctcaactctgacattcccttgccagctgtgtgactttaggcaagttaatgcacttccctgagcctctgtttccgcctctgtacatttcatttgataaacatttcttgagtgtctgctaggtgccagcactgttccagggcctggagataaacggaggtgaaaacacaggaaaaagccctgccctcttgtagttacagcaaaaaccaagat

SEQ ID NO: 74725 - DNA, 328 bp, Homo sapiens
ggcaagagcagtaatttttgagttttttagtcactgaaccctttcttgaaacccttaacatatagcaagaacataaaccaaaaaagcaaagttgctgtgcttgaaggtctcggattgggggcctgaacctgcctggccctactgctaaagcgcttgcctcaaagaaataagagcacagtttgaaacacctgcaatacagaatacaaaatatgcttcagacaaatctcttactcctaataaatttataatcttcctagagaacagttgaatgcagcacatcaatggagtgctaaattggttcagtcaagaaaatcagaaagtgcaaatt

SEQ ID NO: 74726 - DNA, 231 bp, Homo sapiens
tgctttgatgggcattttgtccaattctttgttcaaaacgccaagaacctggacaactttcagtcatcaccctctaccgctaacagactgggagcagtgtggtgtagtagctaagccccatggagtgattaagcgagcaggtaatctgggttcaatgtttggttttgctctccatatcagctatgtgaccttcagtaaaatctctggaagccttgcttttttctcatttga

SEQ ID NO: 74727 - DNA, 527 bp, Homo sapiens
cactccagcctgggtgacaaagtgagactccgtctcaaaaataaataaataaaataaaataaaatttaatgatcctagaatttattttgagagcattagaaaacacagataagtataaaaaccagtatcaaatcaactttactgatcaagctctgcttaggattctgtttcctccattttctcttttccattttatttgttcaacaggagagtcaccaaaaagtagagagcaatagaaggaggaggagaataggattcacatgtattgaatgtcttttatacaccaggtagcactaagctcttaacatattttatctcatctaatagatacaacactatgagatggaaattattcagctgctgatataatggagatcccaagagatcagagtgacttgcccagggtcacagaaccagtaatagacctgagttcaaattctgcctctatgtggcccataagcctatgctctttgcattgtagcatatgttttatttaaaacagcctttcccaattatctttcccaaaa

SEQ ID NO: 74728 - DNA, 392 bp, Homo sapiens
gaaatacgaggatattcacctcattttccatcttaaaagattgctcagtatcttcttggatctgaagtgaatggtgactttcagagttttgctatgctgttctattcctgacactcatggtgtgtgagttagaaatattgtttgacaagatttcaagatttgaatgctattacagacaaacctaagccagtatattattcataattattaattgttttaaataattactgatatctgtcagcagttagtggtgaggatcataaaatttctctgctgctgcatctgtatttagtatgagagcaagtctcagaaataatgctgtatctacactgtcatgtatttgccatttgtcatgagaatgtttaaaaacatttgcttgatgaaatttcagt

SEQ ID NO: 74729 - DNA, 602 bp, Homo sapiens
ggggtgggaggatcacttgagcctgggaggcggaggttgcaatgagctatgatcactcaaccggactcctgggtgacagagcaagactgtatctaaaaaaaaaaaaaaaaaagaagattctggaaccagattgacgtttaaataatttatctaatttatctgtgccttggtttccccttctataaaatgagcatgattttatacatgtaggattattgtgagagttttaaaaaagtactgtttttaagggcatagaacaatgcctaatacatatcaagtgctataaaacgattgatgatgatgatgatgtgtggtcatcttgttaaaatctagactccagttacaatgacaccctatctctacagcctcatccattgctcttgaactccaatctacactgtcctttagcctgttcctcataaggaccacccttgtacctttcatttatgggcctttgcagatggtaatgcctgtctccctgactagaatgtaagcttcataagagcagggacttctgtctgttttgttccccactctttcccaaacaactagttcaatcatatttgttcaataaataaatatctactgcaacaactagaaaa

SEQ ID NO: 74730 - DNA, 425 bp, Homo sapiens
agctgaagcttgagctgcttctctggagttctgcccccacggtgctgggaccaaaacagccgacttgacagcccgagggtgggaaggggagtgtgtgtcacctcgagagctgtgagtgcgttgacttggcgcagtggtcagccgagtttctcctgtcacccaccttcctccccacccacctcgctttcctcttagaccagtttggatggggttgtttactgatttagcctttaggtttacattctgctcagcccctggctcctcggaaatcagcaactttcaattaagggaagtggagagtgcatgtgtttgggtgacttcatacacagttcttcctgtaatgaattcggaaatcagacacaatgactggtatttgaaaggtgggatgacttcattttaataaagagaattcaccaacagcattt

SEQ ID NO: 74731 - DNA, 661 bp, Homo sapiens
tttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgta

SEQ ID NO: 74732 - DNA, 2326 bp, Homo sapiens
tttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaattgcaatcatgggcattttaatgtattttaaaataaatttcaaaattctgctaaattcttaatttagcatattgacaaagtaatctggatttataccttttaaaaaccattttgaccagttttcttcggttttaatgctttcttaaataaaacactgcatgatttccaagttgcatatttgcatactattttaatttgcaaaatgttttttaaatcaaatatcctgatatttagttgttttttttttcctccagcgtgtttaattaaatatgttactgtattagcaaaacattttcatttttaaaatctgctaattttaaacttggactgtgttaagtaaaagttaaatcatacactgcaaggtgtaggaagatttgttttaatgaatccagtgatacagatttgattactaagtttgaactgttaattgtttaacaattttagacttgtggctttctttctttggtttatttgtttttgcttttactcctatgctacactagtttgccatgtagcaattgcactgtgcaatattacaataaggactgggaaaattttatggatgtaatgtctattacggtttgcgatagtatttctctctagttctcagtgatttaaatgtgaccaagccttctgtactttgtcacaaaaagcgggttttccaggtgactattttggtgagtgtcaaaataagaatttatggtgtattactgtcgattcactttgaattaaaatatatatattgcagcaaaaaaattgt

SEQ ID NO: 74733 - DNA, 1649 bp, Homo sapiens
tttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccccctcttaatactcaccaaataaattctacttcctgtccacctaaaaaaaaaaaaaaaaaaaaaaaaaaaaaaaaaagaaaaaaaaagaaaaaagcaagagaagaaaggaaaaccaagcactgcgacaccacgacagaaacacagaggacgacctaatgaacgacggccggaacgaaacacacacaccccagagtcaacaaacgaaccacagagaggaaacaagaaacagcggagagaaacaacaacgcagagcagaatccacagcgacgaagacaaccacccctcgagagaaaaagaaccaaacagaataaagcgaaacaaagcaaatgcaaccaagacgcatgacgcaatataacgacacacagacgaaaacaagacgaccgaagagcaacaaacgaagcaataacaa

SEQ ID NO: 74734 - DNA, 1616 bp, Homo sapiens
tttttttttaagtatttttacattgcagtacttgttttgcttgttggtgatgtttgcttatttaatacattccgtcagggacagaaattacatgcttttttttctttctaggaagtgtgttgagttccccccttccccgacatttttttcttttttgggtggtggtgatggtagtggttatgtctgtttaaatgaagttgcttttacagcaccaaagacttaatcatccatttcctatataaaggtagctactttttgcatagacctcaagtatattgtagtgtaaaggtggaatttaaggaaaggtattaaattgaggctgtgttttagcttacaggcaagtaataaattgtatcatttatcttgaatgtatcatagataagctgctatataacgattgccacttcagatagctgtgaaattaggtgattaactagttgttatttagccttctaatttctgtataagtctaattacatgaatagaaattggggttttgattttttactttgcttttctgtttggagtgtcattgtaactactgtattgtaaatggtggaaaataattgcatttgttactttggggtgtgttatttgcatcagtattttatctctattaatgtttgtgctcatcactgcatattaaaaaaacttggatgtatcagtgtaacttaattttttattttcatactggcattgtagacacttgagaaagctgtatcttgcaggcttgacttaacttttttccttaaaaatctggaatataatcttacagcatttactggaataaacagtacaaagcattggagtgtaaaactctagatgttttggatttacagcgtttctttgataaatgaattgtataccactagtacagctctagtacagcgttcacaataagctaataatggataagttttcttcactccattaacacaagcagtgttttatttaataatcatcaatgaaataaatgtgcctgaaattgattttaaaaattacagtattagatcataaagtaaaaaccagcagtacatttttagtcacactgaaaatgaaggacttaattttccccacaagtttcagtgtttttagtaattaattctatgcattttatacaaatagaaatatatatatataaaaaattaaatgtttaaaaaggagtagcctaagattaatttaaaagattatttacagatgacacatttatggggtcactatttaagtaaatttgctgccctccacagccttctaattttatttatatgttccagcagattattaggatctgcttacttcttaggaaagaatcaatgctggcaacacattgtttcagaaacaccaagtgcaaaggattgattgtatcacaacaggtacaaaactgacagagttttctttttgtttagggccatgtttactaccctgaaatgttgtattttttgtctttaatttccaagacttaaagcagtcttgttaaattgacataaatggtaaacttcaacattttcataatacagtattaatgtttgataaaggtatatcccagttaactacactgctctttaatttattttaaaatacattaaaatgcccatgattgcaattaaaggtcgacc

SEQ ID NO: 74735 - DNA, 603 bp, Homo sapiens
agcttgcatctttcctatcaaggttgtaattcagtccatagtgttttgatgctttgcttgtccaccaagcatttcatatacatttgttcatttatttattcattcacagccactctcttcatagaccattaatggagacaaacattaatcaaattcttacacaagtaactgcattattctaatgtgtgataaataatacaaatgaagaatgtagaattctaaaatatagtgaaaaaagagaaaggaaggggaattttgctgtggaattgacatgtatacataaatctgaatgatgaggaggatgaaagtgtacgaaaggttaatttatgttgataggaatttttttaaagaaatcgtttaagccaaagttatagaagacaacacattggaggctaacatcataggcaaatgatgaagttggagaatgaagcaacttcctgaccatgttgcagttttggtcttatttacagagcaatgggaagtaattgaaaactttaatcacagtaggatcaagttagatatgcagtaatattacagatcattcaggctacagcatggagaatgaattggaggaggacacgagtggatctacagaaatgagtt

SEQ ID NO: 74736 - DNA, 358 bp, Homo sapiens
gagattttaacagcaattagttaggactactctctccactctaaaatttccttggacatacttcctgttatggtgtgtggtattagagacattgcatgcattgtttggatctggctaaaaagatttatgacataatttgcatggtttgcaatcacttcagagtatatctaagttattgctagatatcccagtatgcacgtagctcacaggaaaacacactttgtgcttatcatgtgactcattcaccatcatgacctaagggtgcagtatcctgatataaaccttgctcctgaagtatgttgataagagaggtgaaagtgaagcaaagcttcaaatatgtggagctagaaactactct

SEQ ID NO: 74737 - DNA, 441 bp, Homo sapiens
tgtaaagaaaaccaaagaatgatcaatagtgatgaaagttatcactatttctggataaaccatgttctacgatagcacataactggtgatagcttggagtcatgcgaagacctctccaagaaaatgaaatgtaaagtgatgacttaaatatggaaaaggaaccatttgattaaaaagccaaactatgaagcttcaaagacaggatgttaccttgtgcaaaaccctgacttggggaaaaactgtgtttcaagagtggaaagagccctgtctcattaggagtgagggtcttgaatggtgcctgtggttgtagacagcagagcagagctttagcatcctggagatttgtaattgtactccacaagtaactaaaggatttaaggcagaggagggaaagaatcttgcttacattacaaaaaataaaaaagaaaaagaagaaataaa

SEQ ID NO: 74738 - DNA, 2624 bp, Homo sapiens
  misc_feature (98)..(98): n is a, c, g, or t
  misc_feature (174)..(174): n is a, c, g, or t
  misc_feature (340)..(340): n is a, c, g, or t
  misc_feature (740)..(740): n is a, c, g, or t
  misc_feature (1332)..(1332): n is a, c, g, or t
acggtccgctgcctccatgtggagggagatacgggaagctgcatgtcaccacggagacttccttgttcgtgtctatatggttcatacatggccttccncttaattaaagatgtcttccgaggaacattttgtctaagaataacccagtggaaatctctcacataagaagtgatngaactacacatctgagtatgagcctgcatggcatagtgagtctgcaactgtgaactcgggaaatcctgtaccttcccgtgcagtcgctccccagccatgcaggtatttccagagcctggagatcccagactacctttcaaaagaatgaattccagacccagagagncccctggaggagattcatggcaagcagccgtacgaaataacagaagccccagagaggggaagcaatttcctgcctaagtcgtccatctgtcagtggcaaagctaggactggaactcaggattctccatccctcttcccaaacctggcactatcttcctggctttctgggtctggagtcccatgttagaggccctctgttttcagagcaggactcattgaatatgtgtgctctttctactcaagtgcttcaaggatccttcctggaaaagcctcggttccggaccagtgctgtcatggcctcaccatgtcatagaattcccatcatttcacttgtgactcccttcttcctaggacccgggcataaattcttgaagagttgatctgagtgacagactcccangctatgccaaaaacggcctcttatttcccaatgattgagaccttttatttgatcaatctcatgtgctcactggaccccagtgataccttcacatacctgacacctcagggaaacacagcttccgttcaagtcaagatccttgctatactgcaaactcttatgaaacgtctaggagaattttcaggctcctttgtatatggaaaaaggtcagaatgaagctccaaattcttcagcatgtgtaaaaacttaagacaaccatattttatttttgttttattttttatttttttcattgtttttttttttgagacagccttgctctgttgcctaggctggagtgcagtggcgcgatctcggctcattgcaacttccacctcctgggttcaagcgattcttgtgcctcagcctcccaagtagctggaattacaggcatgcaccaccattcacagctaatttttgtatttttagtagagatggggtttcaccatgttggccaggctggtctcgacctcctgacctcaggtgatccagtcgtcttggcctcccaaagtgctgggattacaggcatgagcccctgtgcccagccaacaantacattttaaagcaactttattctcaactgaatgacattttaatcactttcttgcccatgtggatatggataaggatattttgccaatattcttgtttgtgtttgactgtgatgctattgttatacaaagaatgggcaggtggagctaagcagaaagagacagtcgggtacctgtaccatggaaaatggaagagagccaagcagactgcatccttagggggcagggaggtcagtgcaagttgggacaaagcctagctgagtcggtgagcacttcatggcagactagtcaaattatatctcttggactaagatcttcattaaaggcctgcacctcagagacatttcagcctaccaaggtgcatcattatggaagactgggcatgataatagtaatttaaatgaagttaaaagagcagtctaaattagaacaggtattcacattccaatttctcttgagaagagcctctgttggataaagaaaactcgctgagcaaaataaatcgattggaggtaaactttaccagccctggagtgcaaggtttagaaacatgcacacatcccacggtgttaagggtcctgctgttttcttccatgtcatttcatcacagaacaattttctacagcaacctgatctaccttgtggcccagtaaggcatgttttgttttgagatggagtctcactctgtcgcccaggctgtagtgcagtggcgtgatctccgctcactgcaagcactgcctcccgggttcacgccattctcctgcctcagcctcccaagtagctgggactacaggcgcccgccaccatgcccggctaattttctgtatttttattagagacggggtttcaccatgttagccaggatggtctcgatctcctgacctctgggatctgcccgtttcggcctcccaaagtgctgggattacaggtgtgagccaccgctcccagccaagcatgtgagagttttaaatcaaatgttaccttgtccctattagccttaccactgctaaatatctacacggttccctgttaaggagagtttctaaatgactctcttgagaaatcctggataaatggagaatggagcatttttcctgcctctaagctttgctccactgcaatctttcacatgctgtgtatccagagggtgactgccagatagcttcttgaagaaagggaggaggaaacggtcattttcttgctgcgctttctaacacccaacagaggaaatgcacagcataggtgtgtgggagtttggctgacttatggtaaaaaataaacatggtttcctgtt

SEQ ID NO: 74739 - DNA, 354 bp, Homo sapiens
gattggtatacgggcaacaatggattgatagccttaatatagaaatagttccatcaggccagatgcagtggctcaattctgtaaacccagtgctctgcacagctaggaaggaagatcacttgggcccaggagttcaaggctccagtgagctatgatcacgccactgcctccagcctgggtgacagagtgaggccctgtctctaaaaaatgaaatagctccatcaagtcaataattaaaagttcaacagcccaacagaacaaaaattgtaaaagaacacaaatagaaaatgtacaaaataaatattaatgacccataaccctataagggaaagtttaacctctctagtatttttt

SEQ ID NO: 74740 - DNA, 360 bp, Homo sapiens
ggaggttgcagtgagccgagatcatgccagcctgggtgaaagagcaagactccatctcaaaaaacaaaacaaaacaaaagaaaacaaacaaacaaaacattgagaacatcctatcacccctaagagaaagcttgtatccatgagcagtcacttccccattccgcccttcctcccaacccaacaactactacatccactttctgtcttgatgaattgcctgggcatttcatagcaatgggaccctaccatatggagtcctttgcgtctggcttctttcacttagcacagcgttttcagggtcatccttgctgcagtatgtgtcagggcttcatttcttttcatggctgaataatgttccac

SEQ ID NO: 74741 - DNA, 461 bp, Homo sapiens
tttttttaacttgaaagaacagctaacagacagattagaacagaattggctatttgacagattttctcagatgaactgtgatagtcatttcaagggaagtagctgcaagcatttgttggctgaaataaaatttaagtttatcatggaaaattagaatttgaaaaaacttagagtttaccacttgacagtatcctaaatacatatgacttttctgatgagtgccgatattaatgaaggttatttaaaaaatattaaataatgtataattctttttatataacagttaaaaataaaaccatgagtactagaataaaacataggtggctctttaatcttggtttgtgaaggtattttttaaaataagaaaaaagcaagaaatcactgctaaatttgactattaaaattaatttatcacaggcacaaaaatgttagaaaactaatggcaatagcaaatatatata

SEQ ID NO: 74742 - DNA, 371 bp, Homo sapiens
aaagagacaaggtctctctctctcttgcccaggttggagtgcagtggcaccatgatagctcattgcagcctccaactcctgggctcaagggatccttctgcctcagcctcctgaagtacttgggaccacagtcacataccactatgcctggctaattttttaatttttaatttttattttttagagacagggtctcattttgttgcccaggctggtctcaaactcctggcttcaagcaatcctcccacctcagcttcctaaagtactgggattacaggtgtgagctacctgtgcctggcccaggttgcattttaaaataaggggtagggagcttttagatgaggcctcatggaataggtcacatttgtgca

SEQ ID NO: 74743 - DNA, 245 bp, Homo sapiens
agtctagggaaacaggccccacccccggagcttccccttgctgcccttggctcaggggcagcacccgcttcaactggcactccgctccatccatggtgctgctttaccactgcctccctggacctgctgatgccctaccccataccccgcccccagcctgctcctgctgaagccaggccagcatgaagtcctcaggaaggctgggatgagcctcccatctcatttctgaggggtctgagccccat

SEQ ID NO: 74744 - DNA, 668 bp, Homo sapiens
ctgcaaaatacattaacccaatcccaacatcctcaaaattcaaaagtccaaaatctcatcatcatataaattatctaaatcaggtataaatgagactctggatatggaccaggatgaggcaaaatttctatctgtgaacctgtgaaactagaaaacaagttatcttcttccaaaatacaatggtgggacaagcatgggtaaccgttatcgacattcccatttaaccggggaggaaaaaggaggaaagaaaagaatcactaatcccaagcaattttgaaatccagtaggacaaattccttcaggcttgaaggctttggctcaggcctctgccctcagggcctgaggctctaccctctgggctatcctttctttttcttgaagggtagcacatgttgcagttcagttttatcaacctatgctgccaggttcaaattttaaagtcttcctcgagcagcaagaaaagacaaattagctgtctttggctgtgttcctctcaatagccatatcagcagtgcgttctatcttcagcaacgtcttgcaaactaaatttgagtatgaggctttggttaagatcactgtgtataagatatggctggccaggagtggtggctcatgcctataattccagcactttgggaggccgaggcgggtgtatcacctgatgtcag

SEQ ID NO: 74745 - DNA, 614 bp, Homo sapiens
ctgcaaaatacattaacccaatcccaacatcctcaaaattcaaaagtccaaaatctcatcatcatataaattatctaaatcaggtataaatgagactctggatatggaccaggatgaggcaaaatttctatctgtgaacctgtgaaactagaaaacaagttatcttcttccaaaatacaatggtgggacaagcatgggtaaccgttatcgacattcccattgaaatccagtaggacaaattccttcaggcttgaaggctttggctcaggcctctgccctcagggcctgaggctctaccctctgggctatcctttctttttcttgaagggtagcacatgttgcagttcagttttatcaacctatgctgccaggttcaaattttaaagtcttcctcgagcagcaagaaaagacaaattagctgtctttggctgtgttcctctcaatagccatatcagcagtgcgttctatcttcagcaacgtcttgcaaactaaatttgagtatgaggctttggttaagatcactgtgtataagatatggctggccaggagtggtggctcatgcctataattccagcactttgggaggccgaggcgggtgtatcacctgatgtcag

SEQ ID NO: 74746 - DNA, 805 bp, Homo sapiens
agggcggggagtgaagaccctggactgtggtcagaccgagctgggcgagtaacggcttgaggtgcggcggagccctaactagggacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttatatttagatttatataactgggtttgtgaatatcttctaatactggggaaatgcttcctgtcttagaac

SEQ ID NO: 74747 - DNA, 147 bp, Homo sapiens
tggtaaggagtgaagaagtgttgctttcccagcctcctctccactgggaaaagaaagagagaggcaaatggggtgacgacgatacatcaaaccactttttgcccgtgtcttcctgggccaagaagaaatacttcaaaagcacagtgt

SEQ ID NO: 74748 - DNA, 287 bp, Homo sapiens
gaaacaagggactggtgacctgaactgccacccccctccctggtgctcagatgcaatgaaattgtgaggcaacaaatctatggctaggtaaagggtcaactccatttcagcaaatgtttcagatgttccttcccgcctagtaatgttccagctttaccccagccttaatcttttaaaatgtatattttccttggtgttgattttaaagtaattcgtatgtatttattacactgggtttgttgcagtaagccacctcgaatgttgctgtagaattaaagtaagcaaat

SEQ ID NO: 74749 - DNA, 687 bp, Homo sapiens
  misc_feature (2)..(2): n is a, c, g, or t
  misc_feature (684)..(685): n is a, c, g, or t
  misc_feature (687)..(687): n is a, c, g, or t
anacccagaacaaagacctgagtggttttggttctgttgtgtgagttgtagttcaaatattcgccttctgttcattaaaggcatactcagagcaatgctgggaaatacagcaatctgtcttgcatcaaagcaatcccacagtgagatctgcccagcatatattttcctggcatgatgtggtgagattcagtctaagcacgttacttcagttttgatatcacagggaaagcacagaacatatcttttcatagtaccacagatttttgctgcatcctgtaaatgacacatgttaccactttttggtggatgagctccagggctaacagagcctgcggtttgtagtgttcctagtgtgagaaagaggttgccctttctccagcgctctgtgctcccattcccctacattgactaatctaactactcagtaattcaaggatttctttcaaggagaggacaaaactcggctccacattgcataattctaacacccttgagagagagagagcacacatactgacatattcctaggatagaaaaaaatgggcaatgttttgaggaagttagtctatgatgagggagagattagaaagctggaaaagtgttgtaaaggttgttttactttaataaatgctggagtttgtttataagttataacaacaagctaatataagattttaattaagnngn

SEQ ID NO: 74750 - DNA, 789 bp, Homo sapiens
ggccacccacatagaagagacatagaagatctcccagctcttcctgggagcaaagctgtgcaacccagagcctcaagctgccgctttggcaggaaagccaactcccgcgtgctgaagtcactgaatgcacaccagagagaaacccacttcgcaggaagcaaatgctttgtctcatttacatttttcgcaggtgttctgggatgtgaaggggacgtgtccaacgtccaggtccttcgtcacagccataaaggaggccatgcgtgggacacgccctcattccaggcaatgtgagagacgccttcaccttgaccgtgttgctgcctctcgttccaaccgtgctcagaaccaggagccggcggggacggagccacagagcagccgcttccccgtgtccgcgcccctgtactgtcttcacactcgccatcaccttgcacaccctgcggcaccacacgaccgccacggagcctgtggggccctcctgtgtctcaaacccgagcccttccccggcgcccacatccaggttgccaactaggaggaggcaggcctggggcactggcaggaggacgggtgggcacaggaaaacctgcctgaagatgaggtcatgaggaaggcagcacagaaggatgggagaagaggccttaagacacataatgtgagcacctggatccagctgtgcctgaagccccttggacttccaggttatgtaagcccattccttacaaccctttgcatttgttttctgccccttgcaaataaaagaccatgacctttcacgctatgagcagctga

SEQ ID NO: 74751 - DNA, 436 bp, Homo sapiens
gcatcttatgatttatcacgatggcatctcttcctctttatgtcctccctctccttttctctcctctttattgttagtatctgaaacctctccagacctagaggagtgccaggtgcacagtaaacatccaatgaatatttgttgagtgatacaaatggtcaatggatattgctatgaaaaaaggacaaggctgctcttctcaaaatttcctcacagaaaaatacaataaaacattctgtaactttccggtaaaagcatcatataggtgaccctagatattggcatgtggacttgtttttgccaaataagtaagtaaagatgagaatattaatgtataattttgtgtaatttgcaaagaagaatctatggtatcatgaagtctggggagagagagagagagagagagagagtgtgtgtgtgtgtgtgtgtgtgtgtg

SEQ ID NO: 74752 - DNA, 1261 bp, Homo sapiens
ctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatatattttgttca

SEQ ID NO: 74753 - DNA, 1113 bp, Homo sapiens
  misc_feature (1104)..(1106): n is a, c, g, or t
  misc_feature (1113)..(1113): n is a, c, g, or t
ctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatgactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgagaatgtttttagctggtggcaataaatattagaagcctgcagaatccagctacgaatatagagggttttgctcttgnnnttctggn

SEQ ID NO: 74754 - DNA, 802 bp, Homo sapiens
  misc_feature (793)..(795): n is a, c, g, or t
  misc_feature (802)..(802): n is a, c, g, or t
ctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgagcagcccctgggtgcgtccactttctgggcacgtgaggttgggccttggccgcctgagcccttgagttggtcacttgaaccttgggaatattgagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagggtttgagaatgtttttagctggtggcaataaatattagaagcctgcagaatccagctacgaatatagagggttttgctcttgnnnttctggn

SEQ ID NO: 74755 - DNA, 3633 bp, Homo sapiens
  misc_feature (2865)..(2865): n is a, c, g, or t
  misc_feature (2879)..(2879): n is a, c, g, or t
agctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacagtatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 74756 - DNA, 473 bp, Homo sapiens
tttgatgtgttcatttcagatattgaaaccatctgaaaagaaagctaaataccagtatggtggactgaattctggacgtcctgtcactccacctcgaacagctaatccgccgaagaaaaggcgaagaaaggaattctgtaaagaaaccatcagatttgttaaggacatacttcataatatataagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggtagactagtaaatttgccttacagattttttttttcttctattattcggaaaatacctataataatcaagaggctgtgggaaaacaaagcagtgcttgtatgaaaactcaagtgattaaaactgttttaaacatgactaaac

SEQ ID NO: 74757 - DNA, 3018 bp, Homo sapiens
  misc_feature (2865)..(2865): n is a, c, g, or t
  misc_feature (2879)..(2879): n is a, c, g, or t
agctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacagtatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattg

SEQ ID NO: 74758 - DNA, 2886 bp, Homo sapiens
  misc_feature (2733)..(2733): n is a, c, g, or t
  misc_feature (2747)..(2747): n is a, c, g, or t
agcgggagagctgcgtgacgcggcggcgcgcaagggacgtgcggagtgagtggcgctgcgggtggggccgtcggcggcgctggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacagtatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattg

SEQ ID NO: 74759 - DNA, 964 bp, Homo sapiens
agctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacagtatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggtagactagtaaatttgccttacagattttttttttcttctattattcggaaaatacctataataatcaagaggctgtgggaaaacaaagcagtgcttgtatgaaaactcaagtgattaaaactgttttaaacatgactaaac

SEQ ID NO: 74760 - DNA, 3142 bp, Homo sapiens
  misc_feature (2374)..(2374): n is a, c, g, or t
  misc_feature (2388)..(2388): n is a, c, g, or t
tttgatgtgttcatttcagatattgaaaccatctgaaaagaaagctaaataccagtatggtggactgaattctggacgtcctgtcactccacctcgaacagctaatccgccgaagaaaaggcgaagaaaggaattctgtaaagaaaccatcagatttgttaaggacatacttcataatatataagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 74761 - DNA, 2919 bp, Homo sapiens
  misc_feature (2151)..(2151): n is a, c, g, or t
  misc_feature (2165)..(2165): n is a, c, g, or t
agctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggcagccattgtggatgagaagatcttctgttgtcatggaggattgtcaccagacctgcaatctatggagcagattcggagaattatgagacctactgatgtccctgatacaggtatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 74762 - DNA, 3204 bp, Homo sapiens
  misc_feature (2436)..(2436): n is a, c, g, or t
  misc_feature (2450)..(2450): n is a, c, g, or t
agctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 74763 - DNA, 632 bp, Homo sapiens
agctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtgaagatttcatggacatttatcacttccccagtcaataatcttataatttcctatgactgtctcttaatctcgttaatcccggcatcttcttaagctgaggatgtatgtcgcctctgatcctgtgatgattgtgtatctgccaccaag

SEQ ID NO: 74764 - DNA, 2855 bp, Homo sapiens
  misc_feature (2702)..(2702): n is a, c, g, or t
  misc_feature (2716)..(2716): n is a, c, g, or t
cctgcctcagcctcccgagcagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacagtatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattg

SEQ ID NO: 74765 - DNA, 3441 bp, Homo sapiens
  misc_feature (2673)..(2673): n is a, c, g, or t
  misc_feature (2687)..(2687): n is a, c, g, or t
gaactccgcgggtaagtcgaggcggccgcgggcgcggggtccagggacaccggagagccccaggcggcactaggggttctccgtccccaaagagccagccggggtggcgcgagcctagcgataaggcaccgggagcgaggaatgtgcccatcctcaggccgtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacagtatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 74766 - DNA, 1886 bp, Homo sapiens
  misc_feature (1118)..(1118): n is a, c, g, or t
  misc_feature (1132)..(1132): n is a, c, g, or t
agctttgcggagctgggcggtgccgaggaggaggaggtggcggcctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagaaattcatggacaatatacagatttacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 74767 - DNA, 2911 bp, Homo sapiens
  misc_feature (2143)..(2143): n is a, c, g, or t
  misc_feature (2157)..(2157): n is a, c, g, or t
ttgtttgtaggcgtggttgtcgtggatggggggagtgcgtgcgcctaccggctgctggagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgnattggcacattgtnttacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 74768 - DNA, 369 bp, Homo sapiens
ttttttgtaaaagtcaacctagaactatacacaaatacaaacatgcctaaaatttatgcaaatatgtgacattctcttataaattttcctttatgttcttattcttagtgagttagttggttgtgttagttttctctggtgtgacacactagtattcatggtatgacaaaaatatgtcattacacatgtgcacacacacagagatcctgtgtcaaagtgtggttttgattcaaaaaagtaaaaatataagcatcattatggacatagggataagtattcaacttctttttagaaattcaattgattttgcacttatcctacaaaggtaggatagcttgaattcctagctggagtcctaatgagagaatg

SEQ ID NO: 74769 - DNA, 388 bp, Homo sapiens
catctccctcccactacccagaaaagctagcaagagtgagcatctccaagcaagatggggtacaattttatgttgcacaatcgtatcccatcagctttgccatattctactggttagaagcaattaacaagtctcacccacactcaaggggaggggatttacacaagacatgaatagcataaggtgggtgtattagtctgttcttacacggctgtaaaggattgcctaagactgggaaatttgtaaagaaaagatgtttaattggctcacagtgccacgggctgtacaagaagcaaggctgaagaagcttcaggaaactttcaatcatggcagaaggtgaaggggaaactggcaagtcttacatgacaggagcaggacaaagagagag

SEQ ID NO: 74770 - DNA, 533 bp, Homo sapiens
tcccaaagtgctgggattacaggcgtgagccaccgcggctggtcaataaatgtattttttaaaaagcatgacctaacggagctcatgaaacacttatgggtgtatcttagatgccagacatgggttttaaatttatcaacctgtttagttgtcttagcagccctatgcagtttctgtaaattttctttgattttacagatggggcaataaggcatggagtggttaagttgctaattcaatgtacttccttctagttagtgttcttaaattagtaactgtcaaggccaggatttgaacccaggtaatccaattgtacgggctatatcctatatatcctatgcatagcctatgctcccccttaatttggtgctggtcctgcaggggttaaaaaaaattggctcagcaaggtggctcccagcttacaccagtaatcccagcacttggggaggccaaggcaggtggatagccctgagttcagaagttctagacctgcctggacaatgtggcaaaaccccatctctaccaagaatcca

SEQ ID NO: 74771 - DNA, 487 bp, Homo sapiens
agatgtttatggcatttaatcaaattatcttcaactcttatctccatttgtttcagatccttgcctagttgctccaacccacccttcttactgagaagcaaagcaacagggattatgtacatatcttctttgaattaagtgttcttgctatcacagccgcgaaatccctccatcaccttttaccattgaccactaaatgttagagtaggtagctaagaagacataagcagggcaggagaagggtcccccaccaggaatgtcaggcaaccatcaggtgatggttaggcagctgttaaactgtctctctaaaataataattggttgcagcgagcacgagggaaaggcagtctcccaaaagatagaaaacacctggccgggcgctgtggctcacgcctgtaatcccagcactttgggaggccaaggcgggtggatcacaaggtcaggagatcgagaccatcctggctaacgtggtgaaacctgtctctac

SEQ ID NO: 74772 - DNA, 513 bp, Homo sapiens
atgacaaccctcttcagcaggaagtagatggagggaatgcatacccactttcccttagtcggctatgtcatagtttacacttttgcactagccttttaacaaaccagtacttgaaaaaattaactaacatgctagaaatcacgtacaaattgacagtggggattgtggcaggccaggtttccattagcaaccagaacagtcagttttcactaatcctttactataactctgatgaatatataagttaaacattaaagaactggagaaactggtaactaagtacaatggctggaatgcaaaaacaaacccattaagaccccagaccctaatgattagatacagattgaaagaaacactcctgcttgtaggtgcactcccacacataggcagagagcttaaaatgtgtatatgcactagaaaaaatattgtaactgcgttggtctgatgagttactctgaccttctccttgtaactggttgcaaaaataaactttctttttccccagtctgtctg

SEQ ID NO: 74773 - DNA, 577 bp, Homo sapiens
agtaaatctggaaacagaattggaaaaaatagctttgccccatcatgataggtttcttctgctagtgaaagattaaagctcgaagtatgtgaatagctgagaacagcacagagaaaggttgattgcttcccctccgacagttccaattgattgaaaaaagcctaatttaaagttctgtttgttctatgtcttaaaccatcagaattctcttttgggacctgaggaatgctctggaggaaaaagaatccaaggataaaaagtcattgcaagccaacaattgttcctaatcctcacaaaatgctggagaaattaaatttattctttattgctcaaagtgttacctaggtcactgggcgatgggaaaattggactggaagtcgagtaggcgcaagctttgttttgtgtctagatgcttaaccttagacacgacaaggcatcttagagtgttgtgggaacttggttcagagcattaacaccaagacttttattaccccggatttataataggctgtgctgtcaggagatgaaaatgttgtgtttacatttcagtgttaaatgatcatttaattaacaccta

SEQ ID NO: 74774 - DNA, 334 bp, Homo sapiens
ggatcctcgaactcctgacctcaggtaatctggccaccttggcttctcaaagtgctgggattacaggcatgagccaccacacccaaccaacaagggactaatatgtagaatagtcagttctactataaggcatgcattcatagaaatcacagcaatatgcaaaatcctgcagtcaaaaaccacaaggcttacagagaaaacaggattgtgtcacaatcctcgtaaactttgtcggtgatgcttaaagaaaaagataagaacagaatacaaaggagagaacagtttcacacgggctaggtggttaagaggggggggggggggggggggggaattc

SEQ ID NO: 74775 - DNA, 443 bp, Homo sapiens
ggagggctcagtgttcattttagcagagatgcagctgaagaaaagccatggtattttagcatttaatagtatttagtgtggatttaaaactaaatgataaacacacattgctaaaatgtttaatttcaataaagttaaaatttaatttttagatatacttcattactcagaagacaaaacattaaaaatactgggaatcattcactgaattccacttctagtggtttattctacaaaaacaatcaaaatggatatatctttgtgtttaaagatgttcaccatagcattgtgtaaaagcaaacaaaaaaccaagagaagtgtttttaaaaaattagaaactttctgaatgcacagttgatatttatttatgtcttatttatttaattaatttatttatttatgagacagaatcttactctgtcgcccaggctgtctcagtgacg

SEQ ID NO: 74776 - DNA, 449 bp, Homo sapiens
ttgtcagctgttatcggagacaattctgaggtccaacttggggatgcttccctccagagactattccccttttccaggcgagaccaccctcggccccctcagtgacccttgagacccctggtttaagcagcccctaggcagagaaacatacttgttccctggccgcaggctggctctctgtccctgtgtgtgtccagggagttatctgctttcccaaccacttcccttcatcatccaggcctccacactactctgtctgtttgtttacttagagacagagtcttgctctgccgcccagtctgagtgcagtggtgagctcctagctctctgcagcctcgccctcccaggctggggcaggagaatggcgtgaacctgggaggcaaagcttgcagtgagccaagatcacgccactgcactccagcttgggcgaaagagcgaggctccgtctc

SEQ ID NO: 74777 - DNA, 362 bp, Homo sapiens
ccgcacctggcctctttttttttttttcccagattttaagttgcccagctggatcatggggtatacttctaaaaatcattaccctagcacctccatagatttatatgctctgtaattacctaaggttgatctatctcttctttcctcattcccatagggtaagcaataaatggaggcagtgataatttggacttgaggaaaggatgtgactgttgctgcttggtacaaattctaacacaggcaggtgcttaataagtgagagtaagtggcaggctgtgttttcttcatagaattctctgactttttccccccccgagatagagcctcactctgtcacccaggctggagtgcagtggtgcaat

SEQ ID NO: 74778 - DNA, 575 bp, Homo sapiens
gtaggggtgggatttgctgtgctagaccacttggctccctggcttcagccccctttccaggagagtgaatggttctgtcttgctggcattccaggtgtcactgaggtatgaaaaaaaaaactgcagctagctcagtgtctgcccaaatggccacccagatttgtgcttgaaacccagatccctggtggcataggcaccggagggaatctcctggtctgctggttgcgaagacttgcggggaaaagcatagtatctgggccagggtgcactgttcctcatggcacagtccctcatggcttcccttggctaggggagggagttcccagaccccttgtgcttcccaggtgaggtgacaccctaccctgcttcagctcgctgtctgtgggctgcacccactgtctatccagtcccagtgaggtgaaccgggtacctctgttggaaatgcagaaatcacccgccttctgtgttgatctctctgtgagctgcagaccggagctgttccttttttggccatcttgccctggttcctagtcaagcattttttaagagaggattttcatatagtaaaaaaaaaa

SEQ ID NO: 74779 - DNA, 416 bp, Homo sapiens
atctccctgactgcactctcttccctttgctttataacatttatcacaatctgcagttactttaagtcagcatttggttatttcactgcaggacctacccaaagaggcaacatacagaatcctaccttcagtaccctctctccattttcatttaatcattctgtagcctatctcctaaataaacatagaagttaaataaatacattgtgcttcaggtaaagtctcatagctttcttgccaaggaactcgttgttcctaagttctgagacagagcaagtatgaatggtctactcatttattgccactaaagtgtaaccctcaaggggatactctgtcttgttcctagttgtattccttatacctagcagagtaactgaaacaaccagaggatcaataaagatttgcagaaaaataaa

SEQ ID NO: 74780 - DNA, 427 bp, Homo sapiens
gggacccgcagcagtgccctgtgtccttcctagggggccgcgttggcagcatggcctgcgcacaggtgccagtgtctcagagaaggggccaagccgcacctgctgctctgcccacacttctcccatgcgctgtactctgggccgtgcggctgcacgggtcctgttgcttaatgttgtgggtccatccgtgcccagtgtggctgggcagctgactctgctacatgttaaagaccagcctggccaacatggggaaacccgtctctactaaaactacaaaaattagccaggcatggtggcgcatgcctgtagtcctggctactcgggaggctgaggcaggagaatgtcttgaacctaggaggcggaggttgcagtgagccaagatcgcgccacagcactccagcctgggcaacagcaagactccacctca

SEQ ID NO: 74781 - DNA, 703 bp, Homo sapiens
gtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttggga

SEQ ID NO: 74782 - DNA, 409 bp, Homo sapiens
aaaatgaataatttttactgctgcatcaagaacattcttaagtgaaaccggtactccaaccccaatttgggtggtgatgaagaatacaattcagcgcttcttacagctttgctcgatccctcctaaggcttcagcagtgtctacacaccattgcttttacaccattggtacaaatgttgacatggtgcaaaaagcaagtaacatcttagtgtcattacgaaaatagttttgatctcacagatgccctgaaagagggacatccaggtttctgcccaccacattgtgaaaattgatgattctagataatacaaaatggcttctgttactgttctggtggtttaaaaacaacaaaaaacctcatttagttctctacctagaagagtgaattgcaactctcatcttgtgcttt

SEQ ID NO: 74783 - DNA, 838 bp, Homo sapiens
tgtgttttttattcttgggttgtttgtccacagtggagtggcctccttgggacacaccctgagctgggtcctagagcagccagtcgcctgtggacagtgctgtgggaggcaggctgaccttggggtgcaggggtgggtccaggagggaggtgggggactgcgtggaaggagcagctcaggtctgacctccgcagtctgacagtgcctttccagtcctggggagttaggttctggtgcatttgttgaagaatctcagtctctgtgtggcttggaaagtgcccttgctgtgagctggtttgtgactgaaagtgaaacaaattatagccttgggaagctcatctggcttttagtttccattttggccagatatgtttgttacatagtctccctgcttggctggtaagttgtgtttgttacatagtctccctgcttggctggtcagatgtgtttgttacatacgtctccctacttgttctgcagcttctgtgtttagtatacatttgagcctccttttctccttttcctacaggggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtgagtgcagtgaatgcagggcagctggggcccctcctcctagtcacctcatttaaaaaaaaaaaac

SEQ ID NO: 74784 - DNA, 907 bp, Homo sapiens
tcgctgaggcgtccttctgttttccagggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggtactggcgcgtgcggctgatcacctcaggaaaggtactggcgcgtgtggctgatgtgctgatgccaccatctttcttggaggggacgtgcccgaggagcactgccagtcttctgctgaccccgcagccccagagcacatcttgtctcgttcagtccagttcacaggagggctgaacagtgggaccaggtcgttctgtgaatttcacacttaatttttctctcttttaaaatctttaacatgaagatggcttttctaaactttgatatttgttcatttatttaaatccctttggccgggtgcatggctcacgcctgtaatcccagcactttgagaggccgaggcgggcggatcatgaggtcaggagattgagaccattcttgctgaaacggtgaaaccccgtctctactaaaaatacgaaaaattaggtgggtgtggtggcgggcacctgtagtcccagccacttaggaggctgaggcag

SEQ ID NO: 74785 - DNA, 3715 bp, Homo sapiens
gccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74786 - DNA, 3742 bp, Homo sapiens
gccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtgtgctcacctcggctgctgcttccacaggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74787 - DNA, 4188 bp, Homo sapiens
tgtgttttttattcttgggttgtttgtccacagtggagtggcctccttgggacacaccctgagctgggtcctagagcagccagtcgcctgtggacagtgctgtgggaggcaggctgaccttggggtgcaggggtgggtccaggagggaggtgggggactgcgtggaaggagcagctcaggtctgacctccgcagtctgacagtgcctttccagtcctggggagttaggttctggtgcatttgttgaagaatctcagtctctgtgtggcttggaaagtgcccttgctgtgagctggtttgtgactgaaagtgaaacaaattatagccttgggaagctcatctggcttttagtttccattttggccagatatgtttgttacatagtctccctgcttggctggtaagttgtgtttgttacatagtctccctgcttggctggtcagatgtgtttgttacatacgtctccctacttgttctgcagcttctgtgtttagtatacatttgagcctccttttctccttttcctacaggggaaagccaccagggtgggtggcgagcctgggatcaccagagctgtgatgtccaaaattcagaggtggagtcctcaggggccaggcccagcactctgtcaagagctctgcaggcgtctggcacctgccgacctctgtgtggcttccggctgctgaccacgcttccctcccctccactcagtgtccccgctgagcacccccggggcaggcactgcccctgcccttattccacagtcgtcatagtctttgcgccaaacctttggggaaggcacgctgttttccccatttccagatgaggaggccactgtccagggccatgcagtggtcaggacagacctgagtgtggcgccccccgccccacacctccactcccttccttgtgttctccttgggagcagaagacaagctgttgggacctgacgcttttatttattctccaaattaagtgggaattagatcctctggggaaccctggagcttggtgagagtgacgctgccatggggttgggtccctgaggccttcctcggagcattgggtgccaggggctgcccaggcttcctgagtggcccacctgggtgggaggctgccaccgcggcctgatcatgccctctgtgcccacacaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74788 - DNA, 4146 bp, Homo sapiens
tgtgttttttattcttgggttgtttgtccacagtggagtggcctccttgggacacaccctgagctgggtcctagagcagccagtcgcctgtggacagtgctgtgggaggcaggctgaccttggggtgcaggggtgggtccaggagggaggtgggggactgcgtggaaggagcagctcaggtctgacctccgcagtctgacagtgcctttccagtcctggggagttaggttctggtgcatttgttgaagaatctcagtctctgtgtggcttggaaagtgcccttgctgtgagctggtttgtgactgaaagtgaaacaaattatagccttgggaagctcatctggcttttagtttccattttggccagatatgtttgttacatagtctccctgcttggctggtaagttgtgtttgttacatagtctccctgcttggctggtcagatgtgtttgttacatacgtctccctacttgttctgcagcttctgtgtttagtatacatttgagcctccttttctccttttcctacaggggaaagccaccagggtgggtggcgagcctgggatcaccagagctgtgatgtccaaaattcagctctgcaggcgtctggcacctgccgacctctgtgtggcttccggctgctgaccacgcttccctcccctccactcagtgtccccgctgagcacccccggggcaggcactgcccctgcccttattccacagtcgtcatagtctttgcgccaaacctttggggaaggcacgctgttttccccatttccagatgaggaggccactgtccagggccatgcagtggtcaggacagacctgagtgtggcgccccccgccccacacctccactcccttccttgtgttctccttgggagcagaagacaagctgttgggacctgacgcttttatttattctccaaattaagtgggaattagatcctctggggaaccctggagcttggtgagagtgacgctgccatggggttgggtccctgaggccttcctcggagcattgggtgccaggggctgcccaggcttcctgagtggcccacctgggtgggaggctgccaccgcggcctgatcatgccctctgtgcccacacaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74789 - DNA, 3133 bp, Homo sapiens
tatccggtcactgcgtacgtaagacacggagcggtgggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74790 - DNA, 926 bp, Homo sapiens
gccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtgagtgcagtgaatgcagggcagctggggcccctcctcctagtcacctcatttaaaaaaaaaaaac

SEQ ID NO: 74791 - DNA, 2626 bp, Homo sapiens
tttaccttaattttgccacatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactaacctggagtactgtatcatggtcattggggtccccaacgtgggcaagtcctccctcatcaactccctccggaggcagcacctcaggaaagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74792 - DNA, 467 bp, Homo sapiens
ttgctgccagaccttcctcgaagcttagtgtgagagctgtaatagtgcacagctgacaggcactggtcaccattccaccctgccccatgagtggccttccctttccccatttgacggaccagggcagagaggttggtcgcaggtgccaggcaggagtgggggccgggaccacagccgagtgccgtcctcttggttagtgtctttgtcagtggctggcctcttcctcacggcacggtgtctttgggctaggactggaagggatgtgtttgaacttggcaggaacatagatgtggctgtttccagtgctcacctcggctgctgcttccacaggaacggtgctggaccacctggtcggggaggagaccatggctgactacctgctgtacaccctcaacaaacaccagcgctttgggtgagtgcagtgaatgcagggcagctggggcccctcctcctagtcacctcattta

SEQ ID NO: 74793 - DNA, 3567 bp, Homo sapiens
gccggaagcccgcagtgccggaggcccgcagcgccggaacctcagaggcgggtcgcagcggcgcagaggagggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74794 - DNA, 1659 bp, Homo sapiens
gccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactgggcacaaaaaaaaaaaaataaaaaaaaaaaaaaaagggggggctaaatttctcgggggggcccttctcacagtttttaaagggcctaggaaggtttaaaaaacggggtacaaacggagagagattgtttagacactctgggtggacccacaagcggataatattgtatttggtatcataataataaggggtacgcca

SEQ ID NO: 74795 - DNA, 4276 bp, Homo sapiens
gccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcagaggtggagtcctcaggggccaggcccagcactctgtcaagagctctgcaggcgtctggcacctgccgacctctgtgtggcttccggctgctgaccacgcttccctcccctccactcagtgtccccgctgagcacccccggggcaggcactgcccctgcccttattccacagtcgtcatagtctttgcgccaaacctttggggaaggcacgctgttttccccatttccagatgaggaggccactgtccagggccatgcagtggtcaggacagacctgagtgtggcgccccccgccccacacctccactcccttccttgtgttctccttgggagcagaagacaagctgttgggacctgacgcttttatttattctccaaattaagtgggaattagatcctctggggaaccctggagcttggtgagagtgacgctgccatggggttgggtccctgaggccttcctcggagcattgggtgccaggggctgcccaggcttcctgagtggcccacctgggtgggaggctgccaccgcggcctgatcatgccctctgtgcccacacaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74796 - DNA, 3627 bp, Homo sapiens
tgtgttttttattcttgggttgtttgtccacagtggagtggcctccttgggacacaccctgagctgggtcctagagcagccagtcgcctgtggacagtgctgtgggaggcaggctgaccttggggtgcaggggtgggtccaggagggaggtgggggactgcgtggaaggagcagctcaggtctgacctccgcagtctgacagtgcctttccagtcctggggagttaggttctggtgcatttgttgaagaatctcagtctctgtgtggcttggaaagtgcccttgctgtgagctggtttgtgactgaaagtgaaacaaattatagccttgggaagctcatctggcttttagtttccattttggccagatatgtttgttacatagtctccctgcttggctggtaagttgtgtttgttacatagtctccctgcttggctggtcagatgtgtttgttacatacgtctccctacttgttctgcagcttctgtgtttagtatacatttgagcctccttttctccttttcctacaggggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacgttattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74797 - DNA, 3035 bp, Homo sapiens
gccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtggaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcactggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatcacgaagtgtccatcataactggaacattccatcagcttgcagtgctgtggtgtgtgagggtctggtgcagctcagcccattttccaggtgggcatctgcaaagttgagggggctccggtgggtctctctgctgtgaggagactcagaccaccccctgcctcctgggggaaatgtcagaagggcttctctgcctatgaggatctggggcagggcttggccttggcctgctggtcttggaggcgttgagcttggtctggaaggggtggaggagcgtctgggctcactgggccaggggcattgctggcagtgtggacgggaggctgcagggcgctgcctcctgtggcttagtgccctggagctagagagcagtgcttggttgagtcctgccaacagcttccagatcctcacccaggccagaacccaggccagctggggaaggcagaggctggcagggcccgtggtgggtgctggtcttgactttggtgtccactgagtcccgaggctcaggcccaggagggatgcagtccggctgagggcgaggctgtccccaggacatggagagggtgagatcccaaggccacggggggggggcagggagaacccctcctaccctggatgagtgggtgactggagagctagagaacgtggcagacccaagacctctcagtgctgagcccatggaggatgccccaggctggcgggactgggaagcagagggctggtcttaacacaggtgtgtccagtgctggaggcaagtccttgtcgtgactgtccagcgccactccatgtctctcctgtccttggatgttggggggctcagcctcttgcatgggtgtcctgctgggcgctgggccccgccactggccccctgcttgctttggggtctgagttagctcctggctccactgagcaggccgtcagctgccagcccaccacgcggatacccaggccctgttccgaggcctggaacagctgcttccgaagaaggggctgccttcagggaaatgcgtgcaccgtgcagcctgtgctgtgcccagggaggcctcttcagcgggattggcagttgctgtgccctgagaacaggcagaactgtgtgatccctgaatgtgaacctgaagttcaaaggacttggaaagctctggaatgtgttggtttttcccccccaaaatgggtcctaaggagggtaaagtgacttgtttcaagttgttggagcaaagtgggtctctcacggatctcggcctgagggtgtgggggagaaggcctggacagcccctcagggcagggtgtgttttcccaccagccgcagagagccaggatggacgttcctcggacggacggttttcctgcttgggaatgttcctgggctgtgagatccactcttctgggcaggtggttagcacctaacgtttttccctcacttccccccaaattcttaagtcctttggtcca

SEQ ID NO: 74798 - DNA, 1487 bp, Homo sapiens
gccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaaggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcagaggtggagtcctcaggggccaggcccagcactctgtcaagagctctgcaggcgtctggcacctgccgacctctgtgtggcttccggctgctgaccacgcttccctcccctccactcagtgtccccgctgagcacccccggggcaggcactgcccctgcccttattccacagtcgtcatagtctttgcgccaaacctttggggaaggcacgctgttttccccatttccagatgaggaggccactgtccagggccatgcagtggtcaggacagacctgagtgtggcgccccccgccccacacctccactcccttccttgtgttctccttgggagcagaagacaagctgttgggacctgacgcttttatttattctccaaattaagtgggaattagatcctctggggaaccctggagcttggtgagagtgacgctgccatggggttgggtccctgaggccttcctcggagcattgggtgccaggggctgcccaggcttcctgagtggcccacctgggtgggaggctgccaccgcggcctgatcatgccctctgtgcccacacaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtgagtgcagtgaatgcagggcagctggggcccctcctcctagtcacctcatttaaaaaaaaaaaac

SEQ ID NO: 74799 - DNA, 662 bp, Homo sapiens
cgtatctgaaagactctctggaacacaaccagaatcatgtttggccaaatgtcctggcaccctggtgctcggtcacagtgacaagtacaagtaactatcacacatgccctttgtcatattggtgatttccactgtttttctcccaaactgcagcttatatttgttctcttaatactgttgagcaaaaacttttaatttttataaagtcgaatttatcaatgttttctttaatggtttgtgtttattgataataaagaacactttgcctaactctgtgtcatgaagattttgtcttatattttctgctatactttttctagttttatagtttatatttagttgcataatccattttgagttagtttttgagttagtattgaggttcaggtgaatttttttcctttggggataaaaaaaaaacaaattgtgtaaaaaaaagttgtttctaaacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttccatgaggaataggaaatccccaagcacaattggtggtaccctctac

SEQ ID NO: 74800 - DNA, 116 bp, Homo sapiens
ccagggtgttactgattcagataacttctgagagtacagaagagtttcctgaggatggcgtggccatgctgcctgtacgtaaaacaggacttgacagtgatctggacggagagaat

SEQ ID NO: 74801 - DNA, 561 bp, Homo sapiens
gggttcaagcaattctcctgcctcagcctccccagtagctgggactacaggtgtgcaccactacacccagctaatttttgtatttttagttgagactgggtttcaccatgttggccaggatggttttgatctcttgacttcgtgatctgcctgccttggcctcccaaagtgctgggattacaggtgggagccaccatgcctggctcgaggacctatactttaaaaaatttcacacctggaaaatattttctctaaaaaagctaggatatttcttttaaaaaaccaagaatataatgaaattattgtaattcatctgtttcctttttttctgtggctattagggaatttagaactaaactgaattttctttcataggaaatatgtgaacctagaaattctgttgcatttgtttcttttttttacaaataaaaaatttaagctatatgtgaagttaaaattatttcaaatacttttagaatcaagtggaatataaattatgaatatgtaaaatagctaatggtactatacatcttccaggtcatcctggcagaaatggctttt

SEQ ID NO: 74802 - DNA, 474 bp, Homo sapiens
gagattatccaacaccctaggaggactgttaatactctcagtgataaaaacttaacagcatagaaattcttcaagttacagctgagctgacagtatattaagaaaatgttgttgaaatcagaagtccattcagggcatgcattcttagagagaagtttgtggcaaagcctttgtttgccttaggagctctcttttgagaccagagttgcagagtttggcaattaactagtctggaaggtgaggggagacagattctaagttctgaggaaggagaaagtctaatcagaaattccctcataaaatcagaaactgtgaaagacacccaaggtgatagcctcagcagacaaaatcgacaaaaagccctagcacatcactgccctactcaaaaccccctttgcattcagacaaatgtgcaaactcctccagagggagcccacccatgtgatccactacaaagcctgagtctcaactcat

SEQ ID NO: 74803 - DNA, 220 bp, Homo sapiens
gcactgcactccagcctagactacagagcgagactccatttccaaaaatacatcagaactttctatttattgaaatggtaatttgacaaagggaaaacagcattctctttttattcttaaagagttacttatggccttaaatcaaaaacatattgtcatcatttacagtgtagctccatgtagagataaccaggtctttgacttaagggaaaactgtcac

SEQ ID NO: 74804 - DNA, 325 bp, Homo sapiens
aaaataaaaacaatacaaaggagataaaaatagggggtgtttgtgaaaagggatctttagcttttatgattgaacattaactacatttgtttgaagttgatttcacaaaagtaaatctcagactaaagatgtgaagtacaaccatgactatcagttttgattgttattaggtatttttgaagactgatggtgacttaacaacagcagggactgacttcagtgaaaacaatgacaacttacccaaactgaaatatctaaatgagtattatcatttcgtagtcccttcttcaataagttttatactaaatccagttttgctagcata

SEQ ID NO: 74805 - DNA, 315 bp, Homo sapiens
gagccactgcgcccagctgcctctagacttttcttgtctatgtgccctaagcctgcttctaagacctgtgtgggtctcttcattttctttgttttcctgagggcaggtatgtagaatcctaagcttgagttgtggccaagcatagcgctgctgaaagtacagacagagcttgcatgtgcacatgaggcccttgcaatgcgggatcgaattaggatgggaagagaagcacagtaagagactgaagatctgctcttcccatgctgccaccatccagtggctaactctgaggtgtctgagaattcttaatttgaacct

SEQ ID NO: 74806 - DNA, 388 bp, Homo sapiens
gaaggaatgacaggactaagaggtctgggcatgctgaaggggtggaaaaggaaaaccaacaggcttggagcaaagaaagcaaagggtggagtgatagaaaaggcaggagctggccaggcgctgtgactcacacctgtaatcccagcactttgggaggccaaggcaggtggatcatgaggtcgagagagcgagaccatcctggtcaacatggtaaaaccccgtctctactaagaatacaaaaattagctgggcatgtggcgcatgtctgtaatcccagctactgggaaggctgaggcaggacaatcgcttgaacccaggaggcggaggttgccatgagccgagattgcactgctgcactccatcctggtgacagagcgagactccatct

SEQ ID NO: 74807 - DNA, 281 bp, Homo sapiens
aattaaataatgtcattgccttctagaaattaatcatcaaagatagtaatcatgtggagagaaataataagatacatatttagcaaatgcagaacaataaattagtaaatcatttacattatttgtttaaaagagatgaaggaagagtcctagaaattgctgattgtggagaatcattcccttctctcaattacaatagttaaatgcctcacacaataaatattcttgaataatttatctgccctcagtttattgtaatcttttcctcctctggactagaa

SEQ ID NO: 74808 - DNA, 742 bp, Homo sapiens
tgtccatgatggtgacaaaagctgctggggtcctcagtggcaaaggctactggacttctgctctcctttttccccacagagagaggtcacagccaaaacgatcccctttgttgccaagctgtgccagggtagaagatgaggtgatgcagataaaacgcttccaacacttttatatacagctgtccttggtttgggggtgctttaatgggttcctgcagcttcttcactgtactctggagtattctcagagctatttttgttggcaagtagctgttaaattcttgcttttgttggggagacaagagctgggatctcctagtgtatcatcttgttgatattacttgcctgcttttaatattttaactaatttttctgattacaaaggaattgaggttctctgaagaatatttcagatatttaggaaattttaaaataagatgaaaatattgattaatattctggtataaatccttccagacttttacaatgcatttgtaagtacatctacatttttgcaaagagaatactgtatttttcagatgatcatattgaaaatgcacttttgtcttggtgtactactattttgtgaacattttttgaggtcattatttgtctgtagcttgacttgtaatggctgcctggtattccatcatgactgactttattaaaccactttcatgccattgacatgtcagatgtttccacatttttgctattataaataattctaatactgaacact

SEQ ID NO: 74809 - DNA, 616 bp, Homo sapiens
taacatgagaagagaagagaaaacatctttgtttaaagtttattgtggactttaaatttgggccctttattactcattctaaatttttttcttctgctgtgtgtcgaaacttagtttatatcccattcacatacatttcttcaccattagtcattaagtagctggactggagctgttcaatgaagtttttgatgaccacctttacagtttatcagtcaatagtttaaccacctgatttttgtcaggattgagtagattttaaaacaaactaccctaattttataaatacttagatgtgttgctgaagggatttttaaaaattgtgtgccacatttccagatatgttttattttaagtaagcaacagaataacttttgtttgcaaataatctctgtggcatatgagaaaattacttaaatcctgttttttttttaatttaaaaaaggtgagttatgatttgcagtttcatgtgtaatattaagctagttctttcctctattgggaaagatgtaacgtgtaaccaattggttttcaataaggtattctaaatttgtatacttttctttaaaataatattttttgcttgagaaatccaagttgaagctttctgatatat

SEQ ID NO: 74810 - DNA, 357 bp, Homo sapiens
ttcctgagccagccatttcagcacacatctttgtcatttcttgtcatattgagatcaagtttggccatcctctttgcaaaatcatattcagttttcttaagtaagattgtatttttggcatgcttccattagagtcagagccagcggtggctctcagttgcaatgctcctagagaaagggaactttaattaggacacaatggggttggcctagggctcgagttagattcagtattcaaccaatgttgctgcttaagcctgtaaatgtatggtatgcaacttgtgggtactttccagttttcactgactttcttccaatattgtgtagtgtgtaaagatcggaggtattaaatccagg

SEQ ID NO: 74811 - DNA, 1370 bp, Homo sapiens
aataataatttaatgtactaccaacatatttaaacagactataatccctaaaagataaagataaaatattataaatataaatgtaaaatattatggtaaaagcactttaataattttaaatggttttaactggtttttaatcttttcactctcttttgttggattcctttatttgggagaagacaggggaagggacatttggcatttggtgttgaaaatccagtgtgaatagaaacccgagaggagacttttgattttctgatttctagttccataacatgcaaggtgaagagccacaggagatgaagatggagggataagtaggtgcctatcatgaagtgccttatatatgctatactaagaagtcagaaatgaggtgggatcctctgaagggttttaagtgaggaaatgacttcttagttctattgagaaaaagcacttcagcaattgagtgtggaagaaggggtatgaagaaagcagaccagagtctgtgagactgttagaagacaattaatggaaatcagggtgaagtatagtgagggcatgaactgaaacagtgactgtgaagctatgaggaacctaagaggaatggattcaagggatttttaggaagtagaattgataagatttgggtactgtatcggtgaaggggtggaagttggatgctgttaaagaaaaagagaagtttaggatgactctcaagatgtttttctcgagtacctgggtggtgccatttgcagaaaaaaaaaaggactattttaggagtaggaggttggtggccagccagaggtcaggaaggaattgagggtagaaacttaggaaagatataaaagattcatttgaatttcaaacacagatttaccttgctttgagaaaatatgatgtgattctgtaacctgaaagagtaaaagttaggataagtgtgttatgctgaagctgaataaggggaatgagtttcatgggagagtattgattagggaatttctactagtagaaaacaggatgtccagagtcaaatatttattcttggagacattttttcccagattttctttaatgacagctctcctccattttatatccaaaagctagattggcttattcaaatgtgttaaccctaggatgtgtctgggagtcttctgagtcactactttaaggggatatctatttgaggaggcactatggtaatgaaagcaagtcaaataccaaatgtatggattgctatttaaataaccttgcacaaaccacttaacctctttgggtttccattttctcacttttataaaataagagggttgaatcggatgatctctgataacctttttatagtaagagccctatgattttatgaccctgtgaatagcatgatt

SEQ ID NO: 74812 - DNA, 502 bp, Homo sapiens
tcagtagctgttgcctagttgttcccgaaatgtacatttctctatatcctttctattgcttatatgctttccactggcttctctaatttagaaaagacaacttgtagcatatgaacagtatcttcagaattctaaatactaattcatggcttctgaccacgatggagccagaaactaagctaacctaatctagctagttagtaaataatcctgcataacaggattcctttggttgatggttaataaatatttctctaacaaagtttatattagtctttggacaaaaaaacaatatattatgttttgcttctttaagaaactcatttgattaatgtaatctaagatgagcctttaggtaatgacggtatacttgaccttggagagactcaaatatatgaggaaatacagcaatacttcatatttatcttaattaacagatagtgcctcactgaggtaggcagcctctgatgtgggacccaatgatcccaccttgtggaattaa

SEQ ID NO: 74813 - DNA, 376 bp, Homo sapiens
cggccagagtcaccagcacctgtgggctgcttcaaagaccccacgtgggaggagaccattttctctcttctggctcttctgagggaggggtgtgtggggcagagctgccccctcccactcacagctgttgggctccctctgcccatctctgtgccgcggcctgagccctacagcctgcttcaggggctctcttgtccagggaattgcagtggggccattggagaaagaacagagcgctggccgggcgcagtggctcacgcctgtaatcccagcacactgggaggccaaggcaggtggatcgtgaggtcaggagttcgcgatcagcctggccaacatagtgaaaccccgtctctactaaaaatacaaaaattagctg

SEQ ID NO: 74814 - DNA, 966 bp, Homo sapiens
gaaaaacgaccaaatctaaaaaaacagatgcctcaaattatttaaataatagagaagctacccactaactgtatcttccaagatttatattagataagtatagtattcatttcaaatctctggtgacctattaaggtttcacattcagggatcataacaaaaaaaatacagttacctttaaaagataatccaactcctaggccagagaaagactaaagattttaacacatctgagtaaaaatatgcccatcagagggggtgggatgtttgtcaataatgaagattagaaaaacagcagtcacagagaggaaaaagttggcaggacctgcataaaggaaggcgtggtctttgtcaacagacctggtatctcatcccattaacaaggctagccccactggggtggggggtggcatctgcatcaaactctttggcctcatgacattaaccatgtgaattatataacaagctccctttgttttgtttcagttcaccaagtagccaccttattataatttgaccccttgtaaatctgtcttctgagagagaatctgctggtcatatcaagtcaagtgtttttatccttatgctagttatatttttggttgtgaatcactacctgtaccaactatatgaattgactaacaagagacaggtcttatggtgcaataacaaaaagcagggttctaagtcaataaggctaacagtcacacccaaatagttcactcttcaatgtcatgccacccagcaggctctctcagaaggcagcttgctcctgttgtcacctaaaagtacctctctgtcttcctgcaggtgtcttcaaacttccacatccattatgttgtctatcttgctttcagttggacaagaaaagctaatttataaaattgtacatctctcactctgggaaacaatcacacatagcataatgttagagagcatttctttagttgacatcatttcaggatc

SEQ ID NO: 74815 - DNA, 312 bp, Homo sapiens
aattgcacaacaaccagtataacagctgttggagtgctggatctctgagtcagatggccccctgatcacccagctgtgttagcagagcccagaacccaccacagcagcagcaggcctgcagacacctgttcaatttgctttccctccctctccccacacccactttgcattgctcctcatgatgcttcccagccagctgccttccccatcccacgaagctggagcaagagcctgcctgctgcaggcacaccacaccctctccctctggcaatggtgtagtgtgaaggaaaggaaaggagctccgcccacaaa

SEQ ID NO: 74816 - DNA, 622 bp, Homo sapiens
ctcttttgctcaagcaatctgcccacgtcggccttccaaagtgctgggattacaggcatgagccactacacgggccaagaaaccaattttccatcaagatcagcccctttggtgatgtccctgcccaccttccagggtggagataattgtgaaatctgggttatgctctgatgggatccttccttcactcaacctgctctaacatctgcccctcctcccaccagctgttggctgggcccctgtgctgctccctggtgacagcatacatggaggtagattcatatagggccaagcaggtgcaaagccagactgttctgtgggagagcaggcttttgcccacacccacaccaggattatcctaaggcaccagtgaccaatagcgttggtaccatcccaggtattatccatcagacgcttacccagggacaagcccttacctccctgcattggaaatatcagtcacaccctgaggaagatactgttaccattctttttttttaagacagagtcttgctctgtcactcaggctggagtggagtgcagtggtgtgacttcggctcactgcaacctctgcctcccggattcaagcgattctcccgtctcagcctcccaagtagctggg

SEQ ID NO: 74817 - DNA, 475 bp, Homo sapiens
ggcaacaagagcaaaaactccatctcaaaaaaaaaaaaaaaaaagtagatgcattcccattcaggaacgtggcattaagaaataggattcaacaagggaattacactgcaaataaagaggttgctgtgactgcaatgcatctggagctcaagaaaggagacggctggtatcagatggaaaactacacacctaatcaagctttggtaccccaatccagtttgactgactactgctcttcactgtctctctcatgccagggacaagggcttggcacaaataataattataactgaagcagagtatatttaattacgcaatcttagataataaaatttaattccacataatttatacattaaattggagcatttgaaggatttctggcaaaggaaaattggaatggataagtaggattcatttatacatatcattttatcatcaattaataatgaatgtacttaatgtggtaggattt

SEQ ID NO: 74818 - DNA, 498 bp, Homo sapiens
attagtactctaattgaggacctagggtaaagtactatttagtcagagggaaaaaaaaaacccacacaaacacattgttttattctagcagtttgctctaatatacaggtgtctagtcttttggcttccctgggccacattggaagaagaattgtcttgggccacacataaaatacactaacactaatgatagctgatgagctaaagaaaaaatgtcaccaaaaaaatctcataatgttttaagaaagtttacaaatttgttttgggctgcattcaaagctgtcctgggccacatgcagcctgcgggctgtgggttgaacaagcttgctctaatataaatggacaaatggtggtattgaagataaaaagtatagtagaggctgggtgcggtggctcatgctggtaatcccagcattttgggaggctgaagcaggaggatcccttgagcccaggagctgaagaccagcatgggcaatgtaaggagactttatttaaatt

SEQ ID NO: 74819 - DNA, 463 bp, Homo sapiens
atccctgagagctaacaagttgtgtgaccttgggaaaattacttaaccttttctcaaccccagtgttcacatctgtaaaatggggatagcagtagtacctatctctcaggatttctgtgaggattaaatgaagaaacacaggcaaatcacttactacagggttatttgcttagctgttgtcatcttcatcatactatctatacaacgtaactttttacaagtggaactagaccagtagtcacccattttacaatcagatattaacctccatccatagtagtgaacttgcatgtctttgaaaggtccactgtggtcatccatcctgtgaggtctctgcataccaatatgctgcttaggtgaggccagatgtgcctactaggaactgtggttacttgaaccaaacgttggcagatgtccaaagtgcaattcttcatattctaaccagtctctgaaccacccagag

SEQ ID NO: 74820 - DNA, 337 bp, Homo sapiens
tcatatctgctagggagctcactgcctgccacacttacgcaaagaagcaaacatgccaagatctcagcccgaccattttcactgggtcgtggtctcgtttctcccagaagagctgagtgcgagggaaaggcttctctgtagtgatttctgcccggagtcaccaaactcaaagccaggttgacgggtgcccataacaacgtccctccctccttgctctgtcctggggctcactttgtacttcttttcagtgaagacaggaaaagctccaggccgtggttctcaaagtgtggtccctggaccagcagcaacatcacctaggagcctgttaggaaggcac

SEQ ID NO: 74821 - DNA, 353 bp, Homo sapiens
agcctcccaaagggctgaaattagagggatgagccactctgcctggctagcattttataatcaatatagaatccttcggagagcaacttgttaataactattccaaaaaaatgcacatatactctgacttatcagttctagaatgtgccctaagaaatcacatgtgcaatgacatatatgaaagatattcatgtattgtttgtaaaggcaaaagactgaagtaacctaaaagttcatgaaaggggagtatacttaaataagttatagtacacccaatataatggaataccgtacagaggtttaaaaagaacagggcaattcaacctgtgctaatatggaatgacttctaaaat

SEQ ID NO: 74822 - DNA, 327 bp, Homo sapiens
tcaaaatgactagaagagtagaattggaatgtttctaacacaaagaaatgataaatgcttgaggtgatggatatccaattatcttcatttgatcattacacattatatggttgtatcaaaatttcacatgtcccccataaatatgtaaactattatgtagccataaagatttaaaaagaccactttgggaggcagaggggggtggatcacttgagcccaggcattcaagactagcctgagcaacatggcaaaaccctgtctctacaaaatacaaaaaaaattaggcaggcatggtgatgtgcgcctttggttctagctcctgggcag

SEQ ID NO: 74823 - DNA, 889 bp, Homo sapiens
caaaaagtggtagcagagctgcttccagatgacatgaggctaggcattgactacagtagtctccagtggaagtcagtggtgtgtatatctgttattggctttttggtgggtctctcatatttgttcagatttatgcattaggctagaagctgacttttgggaaagaaaatgcaggttctgcaaatactggctgcaccagttctgatgaagcatccatttcttggcatacttagttctgatcaaaaggaatatttagatattgagtaatttttagaagataccagcctagaaaaggaatcgtaaaagatacaaagtcttgtggacgcatacataaagttgaagagaccaactcagtcctgaaggaggaagtaatttcttctgtaaaagaagtaaataaggagagatctaaacccttaagactagaggggatgatgactgaaatagtaagaatgattcatttaccagaagatgatgtaggaaccatcacattgcaagattttccaagcactgccatggctggggctcccttctgtcattctccaggggtctgaaaatagaacccttttcttctattcagactgtgtctgttctctacctcccactccaatatgaggttcattcttgtccgtgcttctaaaaagcacttaagaaccctcctccataggctggagtatttttgttcaacgtcacctttcaaaaacaaatctgagtttcttcaaggctaattcaaatttcaaatgaaccaactgttggacttccagaaattttggacttaaaaaaaatggtctgtcttcaaaagaaattttaatctcattcattatcatcttaagaactgaagacacttgagaatccaatttcaaaataaaagcttgatgaaacttagttctca

SEQ ID NO: 74824 - DNA, 683 bp, Homo sapiens
gggaagattcagtggctggtccagagacagcattcctgagtgctatgggcaggcctgaatcaggggtcccatactgcctgcagacctgttgtcttcaacaccaaggaactgcctgtgagactgaccacagatacccaagcactctgaagtgaatatgtgaaacccgaagaaaagggtaaaatttctaaagcaatgaacatattttaagactttctcaatcttcctctttggagacactctttgtggaatatgaagtgatgagcattcctgaggtttcagggggcagacccagtccctcacatccccaccctagtgcctgagtccacgatccagtatctcctaaccaacagctttattattatattgtcattggaaggagtctttgaaacaactgttgacttgaataatcaatcaattcttgtcagaggtgttttgcaacctctccacaagaatcagaaagtaattccaatcaccttaaatcatgccatttcacccagagacctttactgtgaattagggaaggggggagatcagaagcagagagataaaataccttttgcatattttaaccataatcagtcactttatttcatgactgaatggtgtttgctatcatttcattatagtgaatcatctccaagagaagattccaaattgaagcaattccttggaaacaaacaaac

SEQ ID NO: 74825 - DNA, 4292 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttca

SEQ ID NO: 74826 - DNA, 374 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacggtaccaaggagctagggaggccgagggtgggcccgaccgttggtgcgggctctgggcccggggccttccgtccagaagctggaaccgggggcggggctggggcacagttgtcggcgggaggaagagggaggagacgggaagcttgacagcggccgc

SEQ ID NO: 74827 - DNA, 4408 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74828 - DNA, 4354 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaattaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74829 - DNA, 4510 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaatttctgtggaatgtttaatcttctggatccatgactgtctgatacgttggcaatttaaagtccttttgaaagagagttcatgttacccagctattctctaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74830 - DNA, 5236 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccggtaaacatttaaacttgaaaacttatgatgagttttcttttgatctagcaaacgatatgctttttctcttttgttggctaattcctgcactttttaatttcttcatttgttgaaaatgttttcttctattgaaaacacttttgttcttcgggtatgtaaactcgagcatcctctactgggtggaaatttgcctctgcagtaacacaaacagacttcttgaaattacgaaaacattggaaagtataggcctttcacattagcacaaatgattgagcattttatgctataaagaattacatgcttattgtttttgaaatccaaatatttaaagatacaagactttttacatagaaagtaagacttaacgcattacggggcacaaatatttaatatctaccacaactaggttagaaccattaaccatatttggtatagttacctcatatttaccacaactaggttatatttggtatatttaccacaactaggttagaaccattaatcataattggtactgatttgtgagggagtgtaaaacacataccatttacttaaagtataaacgtgtaatggtaagtactagataggaatcataactgtcttctctgccgttgcaaacctgtagcctaacacaatatttggcaaatgagagctgtgcacttaaaaaaaaaaaaaaagtggaaaaaataaaatttattaaaacctagactttatcgtacttttcagaatttctgtggaatgtttaatcttctggatccatgactgtctgatacgttggcaatttaaagtccttttgaaagagagttcatgttacccagctattctctaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74831 - DNA, 4067 bp, Homo sapiens
ccggctctgagtatagggttgtcagttattccagaatgaactgttgttataatactcatctttgtttcttttgtcttgaaagaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74832 - DNA, 4357 bp, Homo sapiens
atatctaagttagatgagattaatacaatttatatcctgaatgtaatttatatcctaaatgttgaactgtgattaggtttccctaaataatggtgacatctgggatagtttgagttctttctttatagtctaatttacttgaatttcgtaaaaatcaaggaatggacctgattgcgactggttagtaacttgttctagttttgccttcccttatatatttcaggtaagttaagattaatagacacacagtctactaatttgaattaagttttttgaagtatttgaagtgtttatatactgccttttattgttcattacttccagaatgaactgttgttataatactcatctttgtttcttttgtcttgaaagaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74833 - DNA, 3896 bp, Homo sapiens
gagctcggtacccgtttatcatttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74834 - DNA, 4222 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaaacctaaattcatattcattaaaacaacccgactttgattaaagaataattaggtaccgagctcga

SEQ ID NO: 74835 - DNA, 3056 bp, Homo sapiens
attgcgtattacttggtagtatgatttagtgatacacatattatacacgaggaggcgtatgtgagtaaaatgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74836 - DNA, 1846 bp, Homo sapiens
  misc_feature (12)..(12): n is a, c, g, or t
  misc_feature (37)..(37): n is a, c, g, or t
  misc_feature (53)..(53): n is a, c, g, or t
ggatacatttcncccggaaccagctatgcccagattngattcgagtcggaccngatccagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74837 - DNA, 1580 bp, Homo sapiens
ggaaatgaacagtggtatataagcaggcggtaccggccggaatcccgggatatcgctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74838 - DNA, 1421 bp, Homo sapiens
aagagtggtatccacgcagagggcccattacggccggggcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74839 - DNA, 3188 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtcatgtattactgctggggtcc

SEQ ID NO: 74840 - DNA, 2554 bp, Homo sapiens
  misc_feature (2554)..(2554): n is a, c, g, or t
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaatgcacagtgagttctagtatgttgcaactggctttgacttgaaatggttattaaattagcttgcgcaataatactttcaatggactgttctatgcatttgtaagtgcggaagctgctcagctgcctctgttaccctgttcggccatccactaaccattggttggtcctccttaataattcggcacctgttattgactttaaaggtgttcn

SEQ ID NO: 74841 - DNA, 1008 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttg

SEQ ID NO: 74842 - DNA, 2206 bp, Homo sapiens
gcggccgcctccgccaggcgcctgccgccgcctcccttgagactgccgccaagtcggctgtcgagttcccgggcccacagctggcacctgggactcggccttgcccagctagcggggtcgggacggctgggcgccggcgtgctgggcttggcgccggaggagagagcccagacgccgggaacgtcccgggccccgcctctcccccgcccccgcccgaacccccgggcctggggagctggaggaggtgccaagcgggcggaccaccgaggaggacctgggaggggaagtgttagggtaaacgttgggatcgggtttgtagttacctataaagtgattttagaaacacctgcgtggtggcagttgttgacgttcttgttcatcttttcagtcaccctccttccgtcccccattttttccttccatttgtttttcgtgttttacagtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccggtaaacatttaaacttgaaaacttatgatgagttttcttttgatctagcaaacgatatgctttttctcttttgttggctaattcctgcactttttaatttcttcatttgttgaaaatgttttcttctattgaaaacacttttgttcttcgggtatgtaaactcgagcatcctctactgggtggaaatttgcctctgcagtaacacaaacagacttcttgaaattacgaaaacattggaaagtataggcctttcacattagcacaaatgattgagcattttatgctataaagaattacatgcttattgtttttgaaatccaaatatttaaagatacaagactttttacatagaaagtaagacttaacgcattacggggcacaaatatttaatatctaccacaactaggttagaaccattaaccatatttggtatagttacctcatatttaccacaactaggttatatttggtatatttaccacaactaggttagaaccattaatcataattggtactgatttgtgagggagtgtaaaacacataccatttacttaaagtataaacgtgtaatggtaagtactagataggaatcataactgtcttctctgccgttgcaaacctgtagcctaacacaatatttggcaaatgagagctgtgcacttaaaaaaaaaaaaaaagtggaaaaaataaaatttattaaaacctagactttatcgtacttttcagaatttctgtggaatgtttaatcttctggatccatgactgtctgatacgttggcaatttaaagtccttttgaaagagagttcatgttacccagctattctctagtatgtattcatggaatactccatcgtttctgattacacttatgagacataattcttcagagcacacttagaattatttctctaacatatttatgcagacagaattccatcttgaattttatcaaattcactttaacttcttaagtcttggttattgtaagagcccaaaggtatggccccagggaacaattaagacttgatgatttgtcacctaccaaaatatgttcattatgtaaaggtttcaatgcccataaggctgtcatttggtatttagtgcagtgctcataaaaatataaatatttggacaaatattgaagatacgtactttttccatcaaattttaattgaggttctgctgtatactagactctatgttcttgattttgttcttactagttaagtgaagtattaacaaatgtaattattaattttaatgggaaaaggaaacaagtattagagaagtaagactttgcatatcttaacaccttttggaaaacggaggtatacatgcattacaaaataactttgaactgtatattttggctttacaatttaatgtcattgttgcttttagttgtatttggtctggtttttttttgtggtttttcctcagaacaattttggaaactatattcatcttcatatagaattatggcagtttataggcccacctgtttgaaaaaactttatccacagttgtgttcctaaaatcagttgtcccagaattgtg

SEQ ID NO: 74843 - DNA, 1074 bp, Homo sapiens
aaacgcagtgccctcacttgtggttccgggctggggacggagtgaagtcccacgtatctcaattaagggaagtgctgggtttatatggagaacatagactatccgcaagggagctggttaccgaaagagaagtccctcctccaaaagagcgccttggagggctgcgcaggtgcagatacctctactaagaagacagaagacttactttcatcatctgaatcaaatccaaagagtgtctgacatttcttttgtgcaagatgagcctcaagtgcttctgcattacataaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttg

SEQ ID NO: 74844 - DNA, 4487 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaagattttgaaagcacattttgttttgtgagtcaatgacaaatatatttcctgattacaaaacagcagaaattactgagt

SEQ ID NO: 74845 - DNA, 5461 bp, Homo sapiens
gcggccgcctccgccaggcgcctgccgccgcctcccttgagactgccgccaagtcggctgtcgagttcccgggcccacagctggcacctgggactcggccttgcccagctagcggggtcgggacggctgggcgccggcgtgctgggcttggcgccggaggagagagcccagacgccgggaacgtcccgggccccgcctctcccccgcccccgcccgaacccccgggcctggggagctggaggaggtgccaagcgggcggaccaccgaggaggacctgggaggggaagtgttagggtaaacgttgggatcgggtttgtagttacctataaagtgattttagaaacacctgcgtggtggcagttgttgacgttcttgttcatcttttcagtcaccctccttccgtcccccattttttccttccatttgtttttcgtgttttacagtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccggtaaacatttaaacttgaaaacttatgatgagttttcttttgatctagcaaacgatatgctttttctcttttgttggctaattcctgcactttttaatttcttcatttgttgaaaatgttttcttctattgaaaacacttttgttcttcgggtatgtaaactcgagcatcctctactgggtggaaatttgcctctgcagtaacacaaacagacttcttgaaattacgaaaacattggaaagtataggcctttcacattagcacaaatgattgagcattttatgctataaagaattacatgcttattgtttttgaaatccaaatatttaaagatacaagactttttacatagaaagtaagacttaacgcattacggggcacaaatatttaatatctaccacaactaggttagaaccattaaccatatttggtatagttacctcatatttaccacaactaggttatatttggtatatttaccacaactaggttagaaccattaatcataattggtactgatttgtgagggagtgtaaaacacataccatttacttaaagtataaacgtgtaatggtaagtactagataggaatcataactgtcttctctgccgttgcaaacctgtagcctaacacaatatttggcaaatgagagctgtgcacttaaaaaaaaaaaaaaagtggaaaaaataaaatttattaaaacctagactttatcgtacttttcagaatttctgtggaatgtttaatcttctggatccatgactgtctgatacgttggcaatttaaagtccttttgaaagagagttcatgttacccagctattctctaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74846 - DNA, 5407 bp, Homo sapiens
gcggccgcctccgccaggcgcctgccgccgcctcccttgagactgccgccaagtcggctgtcgagttcccgggcccacagctggcacctgggactcggccttgcccagctagcggggtcgggacggctgggcgccggcgtgctgggcttggcgccggaggagagagcccagacgccgggaacgtcccgggccccgcctctcccccgcccccgcccgaacccccgggcctggggagctggaggaggtgccaagcgggcggaccaccgaggaggacctgggaggggaagtgttagggtaaacgttgggatcgggtttgtagttacctataaagtgattttagaaacacctgcgtggtggcagttgttgacgttcttgttcatcttttcagtcaccctccttccgtcccccattttttccttccatttgtttttcgtgttttacagtaaaggcatgacttcctggcaccacagggaaaatcgggtgcaagcccagaaactatttccccaccaccacttgatttgatgcgtctctggtttcgctctggagaccattccctgctaagtatcaagacgaaaaaaactggaaactaatccggtaaacatttaaacttgaaaacttatgatgagttttcttttgatctagcaaacgatatgctttttctcttttgttggctaattcctgcactttttaatttcttcatttgttgaaaatgttttcttctattgaaaacacttttgttcttcgggtatgtaaactcgagcatcctctactgggtggaaatttgcctctgcagtaacacaaacagacttcttgaaattacgaaaacattggaaagtataggcctttcacattagcacaaatgattgagcattttatgctataaagaattacatgcttattgtttttgaaatccaaatatttaaagatacaagactttttacatagaaagtaagacttaacgcattacggggcacaaatatttaatatctaccacaactaggttagaaccattaaccatatttggtatagttacctcatatttaccacaactaggttatatttggtatatttaccacaactaggttagaaccattaatcataattggtactgatttgtgagggagtgtaaaacacataccatttacttaaagtataaacgtgtaatggtaagtactagataggaatcataactgtcttctctgccgttgcaaacctgtagcctaacacaatatttggcaaatgagagctgtgcacttaaaaaaaaaaaaaaagtggaaaaaataaaatttattaaaacctagactttatcgtacttttcagaatttctgtggaatgtttaatcttctggatccatgactgtctgatacgttggcaatttaaagtccttttgaaagagagttcatgttacccagctattctctaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74847 - DNA, 4474 bp, Homo sapiens
aaacgcagtgccctcacttgtggttccgggctggggacggagtgaagtcccacgtatctcaattaagggaagtgctgggtttatatggagaacatagactatccgcaagggagctggttaccgaaagagaagtccctcctccaaaagagcgccttggagggctgcgcaggtgcagatacctctactaagaagacagaagacttactttcatcatctgaatcaaatccaaagagtgtctgacatttcttttgtgcaagatgagcctcaagtgcttctgcattacataaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaa

SEQ ID NO: 74848 - DNA, 4620 bp, Homo sapiens
  misc_feature (4423)..(4423): n is a, c, g, or t
  misc_feature (4431)..(4431): n is a, c, g, or t
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaaaaaaaaaaaaaaanaaaaaaanaaaaaaaaaaaaataattataaattaattaaattaaaaaaaaaaaaccttgtggcccgtttggcccaattgatttttaaattggacaaggtttttcatgccgccgatatttgggctaatttggccaattcgccctataagggagcgtttaaacattaaatggccgggtttttaaaaggttgaactggga

SEQ ID NO: 74849 - DNA, 4433 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttacacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttactccagctaccgttaaatgagggcaaatcaccttaaaacatgttcatttgattcataacaaggaaaattgggtctatgattttttgccaatcttagcctaaaagaaattgctttagcttctggtcagcactgatttcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaagattttgaaagcacattttgttttgtgagtcaatgacaaatatatttcctgattacaaaacagcagaaattactgagt

SEQ ID NO: 74850 - DNA, 3576 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgataggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggattgtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacaaaaagatacacaatcattctgttttttgaaattccatgtgattcaaactgttccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagctgtgtctggggcggtgggggcggcaggggggggcgggctgcga

SEQ ID NO: 74851 - DNA, 1562 bp, Homo sapiens
tgctggggaccgcctacgggctctgccataggcggtgcaggcggacggggcgcggcgggggacacggcggccgccgcggggctcgatcgggcaacggcggcgacggcggcagcgacggatcctcctcctcccttattcccttgctcctctttcttccttttcttttcctttccggccgggcctcgtccactttccctaacggcggcctcgatcctacgtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggatagtggaaaactgttcttatatcttcagatccctagcagaaatgactgtttatttcaaactatgttttacttgtatatgatgtagtcaccttaactatctttcaattccatacttcccccgcccctagagtgtcggatcctctaggccagc

SEQ ID NO: 74852 - DNA, 1335 bp, Homo sapiens
gcggccgcctccgccaggcgcctgccgccgcctcccttgagactgccgccaagtcggctgtcgagttcccgggcccacagctggcacctgggactcggccttgcccagctagcggggtcgggacggctgggcgccggcgtgctgggcttggcgccggaggagagagcccagacgccgggaacgtcccgggccccgcctctcccccgcccccgcccgaacccccgggcctggggagctggaggaggtgccaagcgggcggaccaccgaggaggacctgggaggggaagtgttagggtaaacgttgggatcgggtttgtagttacctataaagtgattttagaaacacctgcgtggtggcagttgttgacgttcttgttcatcttttcagtcaccctccttccgtcccccattttttccttccatttgtttttcgtgttttacagtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccgaatttctgtggaatgtttaatcttctggatccatgactgtctgatacgttggcaatttaaagtccttttgaaagagagttcatgttacccagctattctctaaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttg

SEQ ID NO: 74853 - DNA, 794 bp, Homo sapiens
agtcccagtgtttagtttctgcattgtttgaaagcaaaattaaaccttaacaaaaacaattcatcactctgtatatatcataaaaagccattaagagactgtttttagaaaatatgataaatatagtccctctatgacaactcatacttgacaacatgtatactttatatccttatcctttagttagtgtcatccttgcagcattcctgtgaggtagggagggcaaagatgagtaactcagttgtcagataagaaaactgaagcttaaaaatgtttagtgaccattcaggagctgaagccttttgtttctgtgatctgtacattttctgccacattctatttcttcatgttacccgacagttttattatatactaaaagtgtctctattctctttggcagattttctttttaggattcctgttttgtgggatgtagtaataataacatttgaaatctattttatgggaaagatcatttcccacttggaagacgagctggaaatgaatgttccagtgcaaattgtttttggtacttgttggcactttattatattaagtgtgttcttatccacagtatctcatagcattactatttagacatactatgcctaatattggacaacatactcagagaaagatgtaataaatgagatttcagggattcaaagaagaatcctatttacctccttcacctgtcctacctgctagtggatttctgaaatgttccaccactttagctgaacagtttgatccctgctaaaataaaaatatccttgatatgtgtcacagtggaa

SEQ ID NO: 74854 - DNA, 397 bp, Homo sapiens
ctataaatatccaccattatgtattgggaagtcgcctggttgtttagcttattcttaacagaattggatgtggactgtaccgtcctttacaaatgattcttatcaagtatataatgtgttcagtactaactcttttcaacttctcactgtcaaacgtaccccacatgaggcatggagagttcctctcactaccaaaactaataaaacaaaaggactgccggactgtccaaagaaacctacaaatgggccttttatagtgacttcaattttatgggataattgtaatgctcccaaggctgttgtactccaaactctagccatgggtattgttattgattgggctccaaaaggacattattggcaagattgctccagcaaaaataccttatgctcggag

SEQ ID NO: 74855 - DNA, 329 bp, Homo sapiens
  misc_feature (205)..(206): n is a, c, g, or t
  misc_feature (227)..(227): n is a, c, g, or t
gcatttgtcagcacagatagagccctgtccctccacctagtgcccactccatgactgtgaataataacaataataataaaactactggccaagcacggtggctcatgcctgtaatcccatcactttgggaggtcgaggtgggcagatcacctggcccaacgccaccgcctctagctccgggctccctgaggtccccagtgccctnnccggtcccacggctcccacgntgccaccctgtcctgactcgccacctggtcttgtgggcagactgctgatcgagttcacctcacccatgcccctggaggcgggtgcagagggagaacccaggc

SEQ ID NO: 74856 - DNA, 343 bp, Homo sapiens
gtaaagatgaggtctcgctatgttacccaggctggtcttgaactcgtgggctcaggtgatcgtactgcctccgcctcccaaagtgctaggattacaggtgcgagccaacatactcagacttaccataattttatattcagcctgattaaaaaaaacggtttaaggaaacaattcactcaatcatttagggccacaaatgactttggtgaagccagagattcagaagatcgacacttttgccatttttccttggcacagactccggcaaaacacagatttactgcatgatagaaagatatcactcattttgacaaagtagtaataaaaagcttcactgatccac

SEQ ID NO: 74857 - DNA, 1032 bp, Homo sapiens
acaagatagcctcttttgggcctctgtttcatctgtgaaatgatgcttttcaattagatgatgtgtggcaagagccacacggtttgagattcacaatattttgcaagtgatatataattaagcaatgctgttttctaaggtattcatgtatatattttaaccccatcctgtaaaattaaagtcaaactttggaaataagacaggtagataccaactggcatgtggcaacttcttggaatctgtctttcagaagcaaaactttatactgtgcatttagtgaatgctcttctgcaaatatacttgagaatgttattcataatcttagacccattctagtaagataagttacagaagtctactacctcctggcctttgtatatcttgttaaaatgttatattagaatgttttatgttttttctaatggctgagcatcagaaagcatcatggagcttttattttgagtcagaagtcttggcattttaaaaaatgttaatacacaatatattagacatctttgtgatttttttttttccctgaaagtacatccacatgtgattttgttgttgttgttgttattgttaatacattatatccagtttaataatgaaatactacttctcaagaaggctttgcttcctccagaagtgatttggtcaaagctaactgtcccatctagtaggaaaagtttaaagactgctagatcatgtccacccacttatttcactgttaatggaagcatttcccaaagtatatatgcattctgggttaaataacctgggccacgtaggtttgggacttactatatgctactcttctcctctctctttattattttattaaaacaataaaaactctgaagtactgtagtataggacttaattcctggggagctttgcaagagcttaagattagaatttttatcttgttttggataatgcacttctaagtttattttttcctaatgatagctcaagaaggatgtttaaaagaaaaatgtaaccccatatcctgtgtatcataaatatatctct

SEQ ID NO: 74858 - DNA, 294 bp, Homo sapiens
gagatgtatcaaatagatttttagagaaaatctggtggctgtaatataattgttagcaaataagaacatcttcatacagcaaacaacctaatagtgaaattccactttactgtgaagaatttctaagacccactggagaagtgttgaactcattataatgatttctttatatgtaaactgttagttctcaattctttgtctataagaaaataacctggtgataataaaaatgaattttagcatggtgcccaagggtttatgtttttaacaaatattgccagttgcttttaatgc

SEQ ID NO: 74859 - DNA, 391 bp, Homo sapiens
gttttattggaactcagccatactcattcatttacttttatctatggccgctttcaagcttacaatggcagagttgaagcgcagtgagaccatatggaatggaaggcctaaaatatttactgtggcccttcccagaggaagtttgccaaggcctgctctcggacatcagttcagtatggccaagagaacgtggtcgtctgcattatctctccatgtctttatcctcactcctgctcacctccttgtggggaaagaacatcattgaagtcatccaagtgccagcctcagataaagcttgaaaagtacgtggcttaaagcttctaggccaggcgcggtggctcacgcctgtaatcccagcactttgggaggccgaggcaggcggatcacgagg

SEQ ID NO: 74860 - DNA, 491 bp, Homo sapiens
agttcccagagccacagacaaaaggtcctcggaggaatctttctctaaactgcttctcctttccaacttcccaaatttgacctcctccagggaccatccttttctgaccacaggaaaagcccttccttaaatcctttaaagcctaggcttaggggattgggctcctgctttaagaggagcatggcagagcgatcaagcacagggacccagcctgcgtctgaagtcactgtcagctctgtcactcactatttccatggcttcggcactttactaacttctctgtgcctctacttcctcttctgaaaatggggacgccgaggtccatggcgttcacctcggagaattaaataaatgaagatgtggaacatccttagaacagtgcctggcacatgcagcctgaacagaactgctgtgcaggaagagaagtgaagacggagaccacccagcgagcacaatgctcaaaggcccaatggatccactcctgaccctgg

SEQ ID NO: 74861 - DNA, 1688 bp, Homo sapiens
gtgcccggcgcgcgacaccagcagccagtcaggaagccctgcgttcatgcttccagccattgtcggagtgtcagccgtcacaaggcacttccagccagtcgcaacggcgggtcgccagcgcctcagtagctcgcgcggtgcctgtcggtagtcgcgtgcggggcggcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccataactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaa

SEQ ID NO: 74862 - DNA, 526 bp, Homo sapiens
ggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctctcgtgtgagggggttgacctgatagacaaccctgtgatcaagaggattgcaaaggagcacggcaagtctcctgctcaggctcaggtagggagggagggctg

SEQ ID NO: 74863 - DNA, 1228 bp, Homo sapiens
gtgcccggcgcgcgacaccagcagccagtcaggaagccctgcgttcatgcttccagccattgtcggagtgtcagccgtcacaaggcacttccagccagtcgcaacggcgggtcgccagcgcctcagtagctcgcgcggtgcctgtcggtagtcgcgtgcggggcggcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaataggtatttatcatacacattttagattaattaaactttctcattata

SEQ ID NO: 74864 - DNA, 1668 bp, Homo sapiens
gaggaagctcagcccacagtgaactgtgctctatttactgtacttcccacagttcagtgtccaaactgagcactgttgccgtgaagatgtcagggtgaacgaggagccctgtgatctcctgaggttcaagagagacttcagaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaa

SEQ ID NO: 74865 - DNA, 1574 bp, Homo sapiens
gaggaagctcagcccacagtgaactgtgctctatttactgtacttcccacagttcagtgtccaaactgagcactgttgccgtgaagatgtcagggtgaacgaggagccctgtgatctcctgaggttcaagagagacttcagaagatggtgagctcctgagggcaaggcccatgcaggtcattttcagcactgcaccctggcctaacttgccccgtgcacaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaa

SEQ ID NO: 74866 - DNA, 490 bp, Homo sapiens
aacgtcatagacttatggaatttctgttaaaacaatgaaatagcatgatacacgattgcagtgcagtagagcttcccccaggaatactgttcccagacttgtgcagggctggttccctcactctttgcctttctgtttgcagcataaatgccacttcattgaggtgttgaggattccctcactctgtcccttccgcctctcaccacaagcacctgctttattttactatagcacctgctctttttttttctcatgcatttgcttttatgctctgtccattcattcctacagatggtgagctcctgagggcaaggcccatgcaggtcattttcagcactgcaccctggcctaacttgccccgtgcacaggtgagtgctccaggcacagtttctgaatgaataaatgagagtatcgaagatcccccttcccacctgtgaggagctcacattgaggagatggatgctcacaggagatgcaagttgggtgggag

SEQ ID NO: 74867 - DNA, 1757 bp, Homo sapiens
gtgcccggcgcgcgacaccagcagccagtcaggaagccctgcgttcatgcttccagccattgtcggagtgtcagccgtcacaaggcacttccagccagtcgcaacggcgggtcgccagcgcctcagtagctcgcgcggtgcctgtcggtagtcgcgtgcggggcggcggggcggcggggcggccggcggcggccatgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggtgtttgattttgaattaacacagcacgatatggataacatcctcagcctaaacaggaatctccgactggccatgttccccatgtaaatatggctccttctttttaaaacagagggaagaatatacagattgaatgattggtgtctgaatagaactaaaaatcacaaagactatcctttccacatagaatactgaggacgcttccccttccttgtttctgctcagcccagatgcacagacactattggcaatgttgaccctcctctgtcatcacagcgccagggcagctgtgcctgggacaggagccacacagtcagagggggatgtaagagccaccttctctgacaaatctggagaattgagtgtgttctaagtgaaggcaatggggtttctccaagacagcctgtgtggcctctactctgaacaaatacactgatgagtcatcagtgaaatttgccttcacattttaagaaaactttatcttatggagttatttaagccatctacagagctgaggaaacagtgtaatgtgtctctgccccattgcgcagctccacccattgtgccccaggccagcccgcgtcacctacacttccttctgtgccctgccagtgacccccaggttattctaaagcagagtccttcccttcccccagtgagaaggaaaatgggataagtctgggacactgtttcagttcaataaagaggcttttttcttccttaaaa

SEQ ID NO: 74868 - DNA, 945 bp, Homo sapiens
gtgcccggcgcgcgacaccagcagccagtcaggaagccctgcgttcatgcttccagccattgtcggagtgtcagccgtcacaaggcacttccagccagtcgcaacggcgggtcgccagcgcctcagtagctcgcgcggtgcctgtcggtagtcgcgtgcggggcggcggggcggcggggcggccggcggcggccatgggagatatcccagccgtgggcctcagctcctggaaggtgacgcggtcgcgggcagggaggcgcgcctgacctaggggagcgcgggacttgggggcgcccgatgggacccaggccggggctggggagaagtgcggcggcctcccctccgcctggccgacgcccgggaaaggcgctgctgaggtggccgcccaccgcccacaagcagcccggcccggcctttcctaaaacggagtcggtgctgcccgccgaggcgctctctgggagaagcgggaacctcggcagccaagcctcagactctggggctgcggccgcggcgttgggcggggctgctctgtggagaggcggagcccttgaagttactcagaactggagcggggatgccgaggggaggccttggcggcgctggactcggccggaacagggaacctcgaagcctcctctccagcaaagagagaaagaaaagttggggccgggcgtggggtgcgggcttgtaatcccagcactttgggaggccgaggcagtaggatcgcctgagctcaggagttcaagaccagccaggtcaacatggcgaaaccctgtttctacaaaaaatgaacaaatcagctgggcttgggggtgcgcgcctgtggtcccagctactcaggaggctgaggtgggaggatcactggagaccaggaagtcgatgctgcagtgagctttgatggcgccactgcactccagccttggggacagagccagaccttgctgg

SEQ ID NO: 74869 - DNA, 882 bp, Homo sapiens
gaggaagctcagcccacagtgaactgtgctctatttactgtacttcccacagttcagtgtccaaactgagcactgttgccgtgaagatgtcagggtgaacgaggagccctgtgatctcctgaggttcaagagagacttcagaagatggtgagctcctgagggcaaggcccatgcaggtcattttcagcactgcaccctggcctaacttgccccgtgcacaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggtctgctacacactgaggggaaatgccatcctca

SEQ ID NO: 74870 - DNA, 346 bp, Homo sapiens
  misc_feature (3)..(3): n is a, c, g, or t
  misc_feature (321)..(321): n is a, c, g, or t
agnggacgcaagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcctccactgacttcctcccaagcccgtgcaccctggaaggcaaggtctggcggctccatccgtggctgcaggggtctcaatgtngtccgtcctcgccatgtttggaaat

SEQ ID NO: 74871 - DNA, 297 bp, Homo sapiens
tgtcttccagtaagtcaggaatctgaactgcaacagacccttctttagtctctttctcttcattcactggatgtgctgggaaattacctctatctgcatatccttctagggctctggcctctcctggtaggctctggtcttctactggcactccaggaaggaggtgaccttttgctagctctgtgactttctctactgaatgcttagacgcaccactgtgcactgactcagattctcctatcacatgcccttcatcgatccctgcttcatttttcatggaatcagcaagctcagctt

SEQ ID NO: 74872 - DNA, 85 bp, Homo sapiens
aaaattccaaagtctcagtcctcataggtcttcaattaaaatagatacctctatgggtagggttcatcaattgttttctgcaaat

SEQ ID NO: 74873 - DNA, 247 bp, Homo sapiens
attagagaataaatgtaggttaattgtagatcatttagatattatgaaagcataaagtgaaaagtatcattaagcatccttttaagatgggtgaggttttacatgcaattttgtgtcacgctttttttacttaatttatctcatgtattttctattacattaaaatcttccttattaatggcttcataaaatccattgtatggccatattatgacttacccaaccattcctcttatattgtctacct

SEQ ID NO: 74874 - DNA, 331 bp, Homo sapiens
gatagccattgaccactaagtggctgttctgatttctttaatatcatatcaaaaatactagtaaagaactttatgctgggcatggtggcttgagcctgtaatgccagctactcgggatgctgagaactggagaatctcttgagcccaggacttcaaggctacagtgagctatgattgcatcattgcactccagcctcggttataaagtaagacactgtctctttttaaaaaaaaaacaaaccagaaaactttctttgtttccatcagatttaaagctaaaattattttctttacctatatattattgtaaactgctttgtatttaaagttg

SEQ ID NO: 74875 - DNA, 1519 bp, Homo sapiens
gcgtgtagctgagcaggcctggggcttgggtctatgtccctgtgtgtcctctggtgtttccaagagcacaagaagcgaataaatctctgacccttctcaggtgcagccagagagacactagcccactgatggatggacagactgtgggcagggtccgtgtcactaaaccacccaccactgccacagctgcctacaacagacacatcagatgacactccgggcaaataaatgattttcactgaggacttactggttttaataataggtcctggtgtagagaagtccctcaacctattgtgcaatgagttttgagaagcgggtaagctgtatgttttgtggttctgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcacggcttttaaggtaaattgtgccatgatccactgccattctaattgctttaacaagtcattaccacactactgttacatcttaattatgcatacagacaggtagacttattttacatatgtgaactaactagttgtcaaagcaaatgcagattgtattctacaagtaaagtctttttctctctgaaatttctagggatgttctttaagtgaaattcatattcaaactgaagattttagttacaagaactgagtgcagattaaagtcttttgtgattcaaacatagtcaagagtacaactgtgatatttcatggaagttatgcaataaaatgtctctaacctgcgaacaaatctatcaagcagacggcacagtactgaatttgaaaccagaaatactgggtttttatataaatgcttcatagatttgttttatgataaagggcacataactctcctaaacctcacaccacctcttgaataggtataataagtccacatcaatgctgatgccttagctattattaaactcttacagtatgatgtaaagtgaaagtacaatgtaagatcattcctaggccaactttgaccagttttatacagaaacatgtgccaacttttctgtttgcaaggataatatcaaagcaaacaccagaaagttatatctttgatgcattttttcaaaatcatacacataatacacaaaccaaagacaaatgatgaatattatgtcagaaaatataaagtcttcccctttcttcttttgccaagaaagtccaatattttcaccatttttatgcacacaatcaactttatttaagctggaagttaatgtctcattgttttcattgttctaaataaacaccttttcccttgagtattgctcaaaaattttgaagttgtgtgaaaaattttgttctgatatttcacgtttgtgctaatgatatgtgaaaaggaatacagatggtatttaattatgaacaggaaaagatgttaaatatcattagtcattagaaatttgcaaattaag

SEQ ID NO: 74876 - DNA, 220 bp, Homo sapiens
tacacaaacttagctggaaatgaatactgaaatggaagtttgaatccaagatgatttcttttgaatcccatgctaatgctgttaactcctatagacccttctcaggtgcagccagagagacactagcccactgatggatggacagactgtgggcagggtccgtgtcactaaaccacccaccactgccacagctgcctacaacagacacatcagatgacac

SEQ ID NO: 74877 - DNA, 727 bp, Homo sapiens
ggtaccataaaagataaaagatctaaaaatggtgccctttaatcaaaagtaaacaccctttaaccatcagagagagggagaagtttggcagctgacctagaagccccatcaactgccccagctcaatgataaactcttctcttcttcaaataaaagcacatcctggcttacatggccatcacttctttgtacaattttatatttttatcatctaaagttatagtttagttttacctttaagagtatatttttatcctcatttattccatagattcctgcttgaaatttatattgtctggtagtttcctgtcctttgcattttgcagattgcaccccaaggtgtggtttaatgtatctctatgacctgtattttctgtaaattggtagtttgttatagaggtttgcgtctattcagggtttttttttttttttttttttttgccatgaggattgatggtactatatcatgtttttcatcaagaggaagaattcaatactagttatttcttttttgtgatgttaattgccattgctgttcagtggctaaatctgttaattcattacaaattgcaaaagtctcagtctttcatttcttttcatatactagctgcataatttctaaaataaaagatttaccctcttccaccagttatcaattcagtagaaacttgttttttgagagactaaaccaagtttctaatcacctatgacccagcaattccacttt

SEQ ID NO: 74878 - DNA, 527 bp, Homo sapiens
tggatttcattattgtttattgagcttcttggatgtttatattcatgtgtttcatgaaatctgagaagttttggctattattcaaatattttttctactcttttatctgtcatttctcatgcaactcccacaatgcattagttggtctgcttgatgatgtctcacgggtcccttaggttctgttcacttttcttgaatctcttttatttctgttcttcagactcagtactttcccttgtcctatctcatgttcactactttttttacctgctcagatatgcttttgaatctctccagtgaattttctgttattgtacttctcatttcctgaattttataatttttatttctcttcattgatatttccgtttcgttcatacagcactttcttgcttttgttcacatcttttaattcttttttttttcttgagacagagtctggctctgtcacccaggctggagtgcagtggtgccatctcggctgactgcaagctccgcctcccgggttcacgccattctcctgcctc

SEQ ID NO: 74879 - DNA, 844 bp, Homo sapiens
agctgggattacaggcgcccgccaccacgcccggctaatttttgtatttttagtagagacagggtttcaccatgttagccaggctggtatcaaactcctgacctcgtgatccacccgtctcagccttccaaagtgctgggattacaggcatgagccaccaccgtgcccagcctgtttagtttatttctaattaacttgaatatttatgaagcatatactttaatcatgtggagattttaattctatgtaatttgatatcattattgaacatctttgtgattcatgtcagttatatgaatttaaacaaaaccaatcttatgaaacacaatttattagatagtctacaaactgctacactcatcatattcagagaaacgtgggaatatgtcagttatttggccttgggtgaatttaagcttctgtttcttattggtaaattgggagtaataaaggtacttttcagagtagctgtataaaattgggaaccaggtctttttgcttaccactgtacatcagcacctagtatagcatttggcacacagtaaacaatcaataaatattagtaaattgaataaaactatgattacataaaatgaaatcatgatatataaagaacttaccacagtacctggtacattacaaattcttaaaaatttatagctattattactattatttcactggagctaattataaagttatagcattttagatgtaaagagaaatctaaagtatattccatctattcctcttattttataaattagttaactgaaaaatcagagaactgaaataatttgcctaaagtgatttacttggttaatatcaaagaaccagaaaccca

SEQ ID NO: 74880 - DNA, 2862 bp, Homo sapiens
  misc_feature (517)..(517): n is a, c, g, or t
  misc_feature (1986)..(1986): n is a, c, g, or t
ctgcaggaatcccccttggagccctcctcccctctgcctgctgtgacctcagcctcggagcctcgagctcccaggagatggctcccagctgggaggacttcactccttcggcggagttgggggactgtgtgcttgggttgggttaatgactgtgtaagccaaggtcaggatcaacccccatcactgggctctgcagaatgccaaaattccagctggggtcccacccctgattcaggaaagttggggctctgaggagttcgggcctatgggattggaggtcctggggggactcatctgtaagctgggatctgatgtccccgggctcttgggagaatggcagccttgcagcccctgctgtgtgccctcatctgggaccttctcctctgtgcactctctcggtcacccacaccccaccagccggctggtccacagggtgtttctgaggcttggcctcttctggctctgtgatctttttttggagacagagcctggctctgtcgcccaggctggagtgcantagtgtggttatcgctcgctgcagcctccaactcctgggctcaagcaatgctcccacctcagcctcccgagcagctgggactacaggcacgcaccaccatgcccagctaatttttttgtattttttgtagagacgggtttcaccatgttgcccaggctggtcttgaactcctggactcaagcgatcctcctgcctcggcctcctaaagtgctaggattacaggcgtaatccactgcgcccagccctggctctgtgattttaccctctccgcacctctgttccttgtggttttaaaggtggagatgctgaggactggcgggagctgcagggctgctgtgggggctcctatgtaggcagtgagggctctttggtcagcttcctccaaggaaggaaggtccctcttctgaaatctcctctggggaaacagctcgcttccctcaccacccccagatgaggagcactgtgctaaggagtctcaggcacctggtcagcaggtcaggcagacccagggagaaggaaggactgtggacctgctgggccgcagagtcagcgattccctgggctccaggctgacgcctgccccgacaaatcaggacattccggccagttcgggggtgggtgtcttcagttccagcccaggcacgagaactgctgaccacttcctgcaggcctccgacccggcggcccagccacccatccggctggggtggccatcagtcatctggaaagcctatgagccccgtgtcctcgttttgcaaagagcagttcctgaaatcatggggcctagagctctgctcttctgatcaggggccggtttcagcagcaaaggccagaaataacacatggtgtgagcgctgctgaatagggcaccgtcctagccctttccgggggatgactcatcatgctaccattccagcaccagctggtacggggctccaggctagcggcttatcatgccggcccggatacacccgtccttaaacttgggtgcgcagaggaatcaactcaggaaggaacctcaggagagatttgtgcaggtccttccccccattcttgggtctgagtagggcttgataatgccttgggaggtgtgcggggccatctttgcttgtttgtgtttctgggaaacactgcgttcagcagagacagcattttatacaggaggaatcggaggccgggaaagatgacggggctgctcagcgtggagctggggtccggccgggctgttttccaggggcaggagctgatctctgagttacatttatttatttatttatttatttattatttttgagacggagtcttgctctgtcacccaggctggagtgcaatggcgcgatctcggctcactgccacctcggcctcccaggttcaagtgattctctcacctctgcctcccaagtagctaagattacaggcacctgccaccacactcagctaatttttgtatttttttttattagagatgngatttcaccatgtgggccaggctggtcccgaactcctgacctcaagtgatctgcacccccctcggcctcccaaagtgctgggattacaggcgtgagccactgcgcccggccctcagtcacctttaaaatgaaagggccacggaatcaccaggaactctccttcctgtgaccttgggtaaaggtcattttcgccctgcccctcagtctccccatttgtaagcctgaaggttgtaaattacaatcttcttatccaaccacttgtctttattttattttattttattttattttattttattttattttattttatttcattttatttttgagatggagtctcactctgttgcccaggctggagtgccgtggcatgatctcagctcactgcaacctctgcctactgggttcaagcaattctcccgcctcagcctcctgagtagctgggatcacaggcgtgtgccacaacgcccagctaatttttgtatttttagtagaggtggggtttcactgtgttggtcaggctggtctcaaactcctgacctcgtgatccacctgccttggtctccctaagtgctgggattacaggcgtgagccacggtgcccggcccacttgtctttatttgttgccttctcttctgctccgagtttaggttcatgtcgccacctggtgattggcttctctgtgcatatatttgcacagttgcaggcatgaccagggtggagcagtgaagcggggcctgacgtgatgtaccatgtttcaagcctgtttcacagcacaagacagcctcagctctgtggtccacaaaccacatgaccacatctggccccctgtcttgtataatagatagttttcttggcatatggccacacccgttc

SEQ ID NO: 74881 - DNA, 451 bp, Homo sapiens
gagaaatttggcagcatcactggaataaatttttgtgtaacttcccaaaattaattccctgaagaatatatctttcatttcaaatataagtacaagtatattttataaaggaagcagctagataacttttgctaaagtaacgtttaaggaaatacagggctgggtacagtggcttacacctgtaattccagcactttggcctcccaaagtgagaggatcacttgagcccaggagagcagcctgggccacatggtgaaaccccctctctaataaaaataaataaatagaatagaataagctaggtatggtgatgccagctacttggtatgtagtcccagctacttgggatgctgatgtgggagaatcaccagagtctgggaaatctaggctgcagttgttggctatgatctcaccactgcactccagcctgggtgatgggagtgaggctctg

SEQ ID NO: 74882 - DNA, 292 bp, Homo sapiens
gcaggagaatcccttgaacctgggaggcggaggttgcagtgagccgagatcacgccactggactccagcctggacaacaagaaggaaactccatctcaaaaaaaattgaaaaaaaattcaagaaatacagaatgcaaaaagggaccaaaaaagtaccaaaaatttcaaaattttgtaaactgtaccaaatctggatacgaagcgttatttttgcccacagggcacttccctgaaagacgttacaatagctaagactcctctcagatagaatagagagcagtagatagctctt

SEQ ID NO: 74883 - DNA, 286 bp, Homo sapiens
cgtcaattcctgtaagacagtcttgatcaatgccaagactttggaaatcctgaatactaaaggcaaaactgtaactccatttaagctccatgatcagaatgagaaataagtaaatatcaaatgagtcagaacgctctcctcctttgcacgagctagtctgcagtactctgcaggacgtttttctgattaaagggcttaagcaatttattttaacaaaagtggtcagtaagctttccagcaatcaaagttgaaagttaagtaaaagatacccttggaaattcttggc

SEQ ID NO: 74884 - DNA, 380 bp, Homo sapiens
cgttagccagtatgttctccagctgacctcgtgatccacccgccttggcctcccaaagtgctgggattataggcgagtatactttctttacttgctgtcattgggcagttgtccgatttcatcctggaggaagcccatgtcaaggacactggccctggttccagaagtagaaagtcaggaaacttccatccaaaggaaaaccagggagtcctctgctaccctcaggagagctaaagggctaaaggacccagaagataatcaactgctctgcatattcttatgaacagaaaatatggagagccagaatactttagggtgtggtaagttccaggcaaatgaaaaatgtaataatcatcaataaagactgatcaattcattcg

SEQ ID NO: 74885 - DNA, 444 bp, Homo sapiens
aacttttttaaaaatgcatttttaaaaatgattttactgaattctacctaattcttacaagggaaaacatagtcttattatatacacagctgattaaaattctaaacatttacccagttacattttaaaattatgcccattgcaaaatctgcacgagaatgagggcagctgtattcacaatcacctgaacgggaagcagctgagatgctcttcaggcagtgagtgcagccacccacattgttacaggaacccagtggaacatgattcactgataaaacttagtaagccgttaagctaaaaaagataggaaaaatcttgcatgcatattgctaagtgaaatcagttagtcctaagtgactgcatactttatgattccaattctatagaatctggggaaagaaaatcgacagaggcagtaaaataaatgatattttattttactca

SEQ ID NO: 74886 - DNA, 888 bp, Homo sapiens
gcaataaaatgcatatacaaccctagtcagtgtgaagtagcacctcataattatttctttagcaaaacatttgaatatactaagtgggatgaatgaagcctcaacttcaagtcaggttttgctgccaagtgattctgagccaaacactcaaaaaattcttttcagaccatcttagagttgggaagttgtggttaaaaaatcgttaccatacatacatccctattttacagatgaagtaactgtggttcagaggttaagttaccaaggttgttcacctaacttaatagcgtcagaaatcggacttaataacagacttaagatattagtctaaataacaggatttagattggacaggagccagatctgcctgattactaacagcctgctctttccattactctcggcttttgggtgatgccacacaacttgcaggcggcatatgcccgtagatttactgatatgcacctaaaaattcagtgtaaatcaagtttactaaaccctgaaattctatagccaaatgcttctgtgatagaaataatcagccctcaatatctgctaagcgtaaattttttccctagtttgcagagagaaactggttgggtgcagtggctcacacctgtaatcccagcactttgaaggctgaggtgggaaaatcgcttgagctcaggagttcaagaccagcctgggcaatgcagcgagacattgtgtctacaaaaaaaatttaaaaattagccatgcattggtgacacgtgcctggagtcccagctactcaggatcaggaagccgaggtgggaggatggcttcagccaaggaagtcaaaactggagtgagtcatgttcaggccacagcattctagcctggacgatggagtgagaccccccccctcaa

SEQ ID NO: 74887 - DNA, 481 bp, Homo sapiens
tgccaactttttttaatgggggtccatacatgtaaaatataggcctgttaatatctgtatcccatatttatatctttgacatttatggtcataacaagaaatatcaggacacatctctgaagattttggcagacaatctgtggtggaggttttgaattcttgtcggcaagcacagtcttccaaagcttagcttctggacctgagggtctgtgaacctgcaacatcagtgtcatctgggagctcattataaatacagtctcagaactcacccccggggcactggaccagtatctgtatttcaataaaattaggggtgtatgtgcttattatagctcatgtctagaaggtcatcctaggcctggcacagtggcacatgcacacacctataatcccagagctttgagaggctgaggtggaaagaccactggaggccaggagttcagagaccagcttggacaacatagcaagactctgtctctac

SEQ ID NO: 74888 - DNA, 103 bp, Homo sapiens
tggccaaattacttgtaggtctgttaatgccatttgcttcctcactcttctgtcagctttgaatgctatgcttttcttttctccttaactaatgcatctctgt

SEQ ID NO: 74889 - DNA, 1496 bp, Homo sapiens
  misc_feature (1381)..(1381): n is a, c, g, or t
aggacagggtcaaccacttggtccatctttcctgttagcatgcccacaacaattcaatgacacataagtgctatgacttcatcaaaaaatgttagacaaatatttgaatttgaagaatcaggatatgattattcttattctcataatttttaccaatataaaagtttttgtcactttacatcattaagtggcaaggtatgtgtgtgcatgtgtgtgtgtattgtctatatatatactatatttctatacagtgggctgagggactgaacggccttagaagttgtgcaaaacaggtgtgcaatgcttgccctcaaggagcttgtaacttaatggaaaggattggacaatacttagaaaaacataccagaacaactggaaaatgaaatagtcagatgcagaaaagtacaatgaaaatgaaatgcgtatatgatgagaaaactctgggtaaagtttaagaagggaaggttcagaaattaatggaaagaaagaaaagaaagaagtgcactttacgagtaaaaactagaatgaacaaatgcaattaaaaatgtatttgtacatgtttttagttttgtgcaaaacaaaacaaaacaaacgacaacaaaattaaaggctcagcagtctgtagacacaaagcctgttcaggttcaaagaaataaaaaattcagatgataggataagtgagaaaaactaatatgtattaaactgaaatggcaaaaaaaaatattttagaaaaaatctctagtttctgaagactcagttccattcaacaaacatttatgggcatttattttttgccagacactataatgggtgctctaggatatttaaagattagcttggccaggtgtggtggctcacacctgtaatctcatcactttgggaggccaatgcaggaagatcacttgagctcaggaattcaagactagcctgggtaacatagcaagaccccgtctctataaaacattaaaaaatagctgagtgtggtggcatgcgtctgcagtcccaggctactcaggaggctgagatgggaggattgcttgagcctgggaggttgaggcagcattgagccatgatcatgccactgcactccagactgcatgacagagcgagacccagcctcaaaataaataaataaataaataaataaataaataaaaaggttagcttgatactatgtctctatatctgcccttggggagcttatagcctaataggatagatgacaagtgcaaaatgattgacatgaaaaagtgcagcccaagtacccagacgagatcttggaggctggagatatttaaatgtctggctctaagtagagaaaagtgattcttagtgaccaagtaaaggaagagattatactaaaaatgatatgggcgacagngcgagactccatctcaaaaagaaggaaagaaagaaaaagaaaaagaaagaaagaaagaaagaaagaaagaaagaaagaaagaaagaaagaaagaaagaaagagagagagagagag

SEQ ID NO: 74890 - DNA, 254 bp, Homo sapiens
ccaaaacaaaataaaaaagtaaaacaaaaagaccaattttactatactacttgatttttaacaatattttatatgtatttaatccagtatatccaaaatattgtcatctcagcataaaacaatattaaaattattcagttttacattttttaaactaaatctagtttgtattttacatatagcataaatcaattcaaatccaccatatttcaagtgttcaatatctacatgtcactagtaatgactatagtgga

SEQ ID NO: 74891 - DNA, 1697 bp, Homo sapiens
  misc_feature (6)..(7): n is a, c, g, or t
  misc_feature (9)..(9): n is a, c, g, or t
  misc_feature (14)..(14): n is a, c, g, or t
  misc_feature (17)..(22): n is a, c, g, or t
ggctgnncnggccnggnnnnnngggacgacccaggctggagctgaggccgagctgagggcgcccgagccccccgccccgcccgtcctctggctccgcagcgctcagccccgggcccgcggagacatgaacgccccgcggccccacgcaccccgggcgcagcggcccggccccgcggccccgtgatgggctcctgcgtgtcgcgagacctgttcacaagtgcccacaagaactgccccatgccccagggtgcggaccccttgaacccagatctgccctcgggccgcactcccaccgtggctccagactgtgtcattggcaaggacaaacagatggatttctgttgggatccttggcagaggtgcttccagaccaccaacggctacctgtccgactccaggtcccgccccggcaactacaacgtggcagccctggccacctcgtcccttgtgggggtggtgcagagcatcaaggaccacatcacaaagcccacggccatggcccaaggccgcgtggcccacctcatcgagtggaagggctggagtgcccagcgggcaggctgggagctgtccccagctgaggatgagcattactgctgcctcccggatgagctgcgtgaggcccgctttgctgcaggggtcgccgagcagtttgccatcacagaggccacactgagcgcttggtcctcgctggacgaagaggagctgcaccccgagaacagcccccagggcatcgtccagctccaagatctggagagcatctaccttcaggacagccttcccagtggcccctcacaggatgacagccttcaggccttctcctcgcccagcccctcccctgacagctgtccctcacctgaggagccccccagcaccgctggcatcccgcagccccccagcccagagctgcagcatcggcggcggctgcccggggcccaaggacccgagggtgggacccaccccccgggctccctcccctccatggacagcggctccctctgggaggaggacgaggtgttctataactgaggtgggggctgtgctggtccagcacctgctctcaccatgacctcgcctggtgggcagcccaggcatatctggaccccggggtccagggcagggcatcccttgacccctcgggtaggcacagggtaggtgcagcagggatggggccagtgctcatggtggcctctctgtgcctcggtggacctgccccagcagtgggagccataaccccctcccccttcattacttcactcaggtgggcaccttcccctgcagggtgtctgccctcagggaactcaaggactctcagagacaccagggcagcctggcccagaggagcaacagccaggcccccaggaggacagccatggagagaactgagacccacttacagtggggtctgggaaccctgcctgtacctggggttcagtccctcccaactccctccttgtgtcttccccccagcaaaggtggggtgaccacttctggtagctaagcacctgctccccggctctcttcacccaggacatctgtctctctggagtgtctgtctgtctgtccctccctctctgaacctgcttcctccgtgtcccctgctcctcgcccctgggagcccactccccctccttgcggctccctcccatctcactcaaggttctctgaggacattaaagtggtggattcaccctggaaaa

SEQ ID NO: 74892 - DNA, 1581 bp, Homo sapiens
  misc_feature (6)..(7): n is a, c, g, or t
  misc_feature (9)..(9): n is a, c, g, or t
  misc_feature (14)..(14): n is a, c, g, or t
  misc_feature (17)..(22): n is a, c, g, or t
  misc_feature (234)..(234): n is a, c, g, or t
ggctgnncnggccnggnnnnnngggacgacccaggctggagctgaggccgagctgagggcgcccgagccccccgccccgcccgtcctctggctccgcagcgctcagccccgggcccgcggagacatgaacgccccgcggccccacgcaccccgggcgcagcggcccggccccgcggccccgtgatgggctcctgcgtgtcgcgaggacaaacagatggatttctgttgggatcnttggcagaggtgcttccagaccaccaacggctacctgtccgactccaggtcccgccccggcaactacaacgtggcagccctggccacctcgtcccttgtgggggtggtgcagagcatcaaggaccacatcacaaagcccacggccatggcccaaggccgcgtggcccacctcatcgagtggaagggctggagtgcccagcgggcaggctgggagctgtccccagctgaggatgagcattactgctgcctcccggatgagctgcgtgaggcccgctttgctgcaggggtcgccgagcagtttgccatcacagaggccacactgagcgcttggtcctcgctggacgaagaggagctgcaccccgagaacagcccccagggcatcgtccagctccaagatctggagagcatctaccttcaggacagccttcccagtggcccctcacaggatgacagccttcaggccttctcctcgcccagcccctcccctgacagctgtccctcacctgaggagccccccagcaccgctggcatcccgcagccccccagcccagagctgcagcatcggcggcggctgcccggggcccaaggacccgagggtgggacccaccccccgggctccctcccctccatggacagcggctccctctgggaggaggacgaggtgttctataactgaggtgggggctgtgctggtccagcacctgctctcaccatgacctcgcctggtgggcagcccaggcatatctggaccccggggtccagggcagggcatcccttgacccctcgggtaggcacagggtaggtgcagcagggatggggccagtgctcatggtggcctctctgtgcctcggtggacctgccccagcagtgggagccataaccccctcccccttcattacttcactcaggtgggcaccttcccctgcagggtgtctgccctcagggaactcaaggactctcagagacaccagggcagcctggcccagaggagcaacagccaggcccccaggaggacagccatggagagaactgagacccacttacagtggggtctgggaaccctgcctgtacctggggttcagtccctcccaactccctccttgtgtcttccccccagcaaaggtggggtgaccacttctggtagctaagcacctgctccccggctctcttcacccaggacatctgtctctctggagtgtctgtctgtctgtccctccctctctgaacctgcttcctccgtgtcccctgctcctcgcccctgggagcccactccccctccttgcggctccctcccatctcactcaaggttctctgaggacattaaagtggtggattcaccctggaaaa

SEQ ID NO: 74893 - DNA, 216 bp, Homo sapiens
agtgaacgtgtgggaatggattggctgaaagccaagctgcaagatcctccctaggtcacaactggcctggcagacggagccttcctagacacctgaagttcccagggaatgcaggatgccaggagttccctgcaagctgcgaggagagaggggcattcccctggacccagccaggagccggagtgacagcactgagtttccgtgtagaagccccca

SEQ ID NO: 74894 - DNA, 489 bp, Homo sapiens
ttcaccatgttagccaggatggtctcgatctcctgaccttgtgatccgcccgcctcggcctcccaaagtgctgggattacaggcttgagccaccatgcccagcctgtagatttctataaacagagaaaagtaccatcaggttggtacttgtcttgtttctgatttcttattttttatagagataggggtctcactttgttgtctaagctggtctcaaacttatggcctcaagttatcctcctacctttgtttccggccttagtggaaaagcttctagtttttcaccattgagtatgatgttaactgtagatttttcaggcgtggcctttatcatgttgaggaagttacatgctattcctagtttgttagatttctttttatcacaagagtattaaatttttaaattagatttgtattgtggtaaaatgtacatgacataaaatttaatgtaaaagaatgaagttagatccttacctatcaccatctaca

SEQ ID NO: 74895 - DNA, 441 bp, Homo sapiens
aaaatatctgtatcttgtgtcacacagtttcaatccaaaatggttgacttctatatctggtacacatttcaccctaggatctctctttaccattataatgttgattctctgtaattctcttctgtgttcaatctatttattttccatattccaaatcttcctttgtcctagtttctcatttgacagcaagtattctccaaaggcctctttggtacaggtaataggatataaatattttaagctcttgcatatctaagagtgtctttattctagtctaaatttgattgatcatttggatggatttagaattctacgctacaataattttccttaaggaatttttaatcaggtccattttttcctcggctgtaggattcaagaatttgaattcaaagagagatgggattcgcatctctatttcttcacttccttctgcacatg

SEQ ID NO: 74896 - DNA, 948 bp, Homo sapiens
gaacctgtattttggtcttgattttgatattaaattgcagtgcgaccttgggcaagtcacttaacctctacacatctcagatatttgtcctctgataaaagaacctcacctctgggtttttcagcagtgctatttttatactgtatgaataggatgagaaatagtattggagagatgaaataatatatttttatagctcaattatattatcttctttttacaggtgagtaaactgaggaacagaagggtaactttctcccagacacattggtagttagtggcaaagacagtggtacttgaggcgggggtctcatgactcaaggacttagttgcacaaatgacaggatttctgctgttcagggcttccttcacagttgtgtgtgtatatgtacacgtgtgtgtatgtatgcatgcatttatcacgatatgcaccaaagagcctttacaaaacattttctaaattgatttacttcttttactcatattaacttatttttataagggatgactagtctatatagaagaaaaacttgtattgttttccataaacagaattatgtaaataatggcaaatacaatgaaaataaaataatgcattaacttcaagctaggtcctgttgctcattgcaagcacccagcctaggccttatctggcattgtttgaaaacagagagattaataagtggcagagagtgtagatgacagactagcaacaaccactttttccttgcacactcagagaaatggagtaagcagggaagaggactgagctccttctgaggagggtcagtgtcattcaatgccaggtttgggcacacatttcagggaagtggggattcagctgggtgacaggaaaggggcaaatgatatattatgtaatatgattcagtatcagaagcattgtgattggtgttagttacaggatgttacaggcactgcggggaaggg

SEQ ID NO: 74897 - DNA, 1419 bp, Homo sapiens
ggtgcctgtagttccagctgtttgggaggctgaggcaggagaatcgcttgaatctgggaggtagaggttagagtgagccgagatcatgccactgcattccagcctgggcgaaaatgccactaatatcacttacataatattaatatatatttgaagtaggggaaaacctggaagattcctcaccaaagttttgacagtgactccagagactgggataactttgtgactttcatttcctcttaaatgttgtgccagggtctgaccggcagacccaggctgcacgatggatgaataatgtactcagacaccgatattcagtgaaagagtgcaccagagggccaggccactcacagaaagggttgtggcagctgcgtgccctgactatctggccctgtgggcctttattcagcacagatttaatgacaaaggctttgagtcaacacacctgtgggtaattaatctggtcgcagtcccccggagagagcagtcctacaaatgatcaaaggagctgggacagttatattcatcagaacagcacggtgtcaaggccctcacccccagaaagcttaggagacactgttttatggaggagagtgagattggaggaacccctgactccaggtctcctgatccttcctacacaaagcgaagctgaaaaaaagtgcaggacactccatttcctcctgggaccagacagggaagccagagccaccatggatgtcaaattccggcaaggaaacaccagtatagcaaaatctccacatcacattttaaagctcacacaatggctcaaagagaacccacatcaaaaaaccgaattcctagctcaggtgagatcaccaaagttgcctgtgaggcttcgtggaacctgcaggtagaaaggacatctttatttcgagctgcagcccagttgcttctgcgtcttggagccccttgaaaggaccctctcccttcaacagtacatagggaggccatttctggggagaaatgtagactgtccttagactcctgaggtttttacacttgcttgctgactctgtggactttgacttcatcattaaacatcttataatgatgtaatttgctttgactgtaagtgtagaacaggacgctgttcctgaatcaggaaacaagggactggtgacctgaactgccaccaccctccctggtgctcagatgcaatgaaatcgtgaggcaacaaatctatggctaggtaaagggtcaactccatttcagcaaatgtttcagatgttccttcctgcctagtaatgttccagctttaccccagccttaatcttttaaaatgtatattttccttagcgttgattttaaagtaattcgtatgtatttattacactgggtttgttgcagtaagccacctcgaatgttgctgtagaattaaagtaagcaaataaatgt

SEQ ID NO: 74898 - DNA, 661 bp, Homo sapiens
tgccactgcattccagcctgggcgaaaatgccactaatatcacttacataatattaatatatatttgaagtaggggaaaacctggaagattcctcaccaaagttttgacagtgactccagagactgggataactttgtgactttcatttcctcttaaatgttgtgccagggtctgaccggcagacccaggctgcacgatggatgaataatgtactcagacaccgatattcagtgaaagagtgcaccagagggccaggccactcacagaaagggttgtggcagctgcgtgccctgactatctggccctgtgggcctttattcagcacagatttaatgacaaaggctttgagtcaacacacctgtgggtaattaatctggtcgcagtcccccggagagagcagtcctacaaatgatcaaaggtaaacatgctctttagataaactctcttacatgtctttgtacttactcgaagctattaactcaaggtaaggggattaggctgctttcagctataaccctatcctgaggcttttgcaaaactttccactttccaagaaggtttgtgtctatttcctataactttatctttataattattcccaccacctgaccaatcccctacaatgttggaattttatcttttagtgtaaacttggatttg

SEQ ID NO: 74899 - DNA, 654 bp, Homo sapiens
aggaggggccaggagccggccggcagagagcggctcgtgggtcccaggacccctgacgtccctaggttgtactgggaggtgcgagcccgaggctcttagtcggcccagcggcacggggcacaagcgggccacagagatgggcagggagctgtgtccccagggtggcggatttccgagccacccacgcgggtggttgggaaagggcggtggattttcctgcggagaaactttcagggcgggcctggcgcgctctctgaccttgggctagttattttgtgtgcagttcacaagatgcctggccgggctccaaactcgctctctgtttggttgtgttttggctcccaagaaggcgaagccaggccttttttcttttgcacaaacagacaggaaaggagagaggaaatgcaagcaaaggtagtaggtaacctaaggtagtataagcccggggtcatctttgtgagtttgcagacttaacgtcgctaggcctcagtactctgcagaaagatggtggaggacctagatgacctcccaggccattccaggaccagtgtttacagtcctgttacataacctagtgtgggtgtgcacacacaggttattatatgttcagcactgtgcccttggaagctatgtttacatttaaagttgtgttgc

SEQ ID NO: 74900 - DNA, 470 bp, Homo sapiens
ctgcctgccccagtttcaggaatggcaccattagagtttaattcctttgggtctggaaggctttttagtctaaaaacagtccatattaacccctccccacaataaaatgtagatatatgtacccttgggattgttcagttcagtaagatcaaagaacagtggaaatatttaggtgtcctaaattataaatggggcgaatgtttattatctttttctagcaagacttctgagtttatcttcatcaatttgagcaaaaaatttaaaatacaatctcctacaaggtagggcgttagttcatttcttttctttgtacagaggccgtcataagaatgttcatgagattctatgtaagtggctcttagaaatctggggttggaaagcaaagcccttaaatgccttctaataattatccacaagtggaatacactggcatccattaaaaattacagaggttattccaatatgaaaaa

SEQ ID NO: 74901 - DNA, 195 bp, Homo sapiens
cttccttctaagagttttagctcttacgggaagttcttcgatccactttgagtgattttgtttccatatatgttatgaagaatgggtctagattcattccttggcatgtggatatttattggcttattctagtatgatttgtttgaaagaactgtttttttctcattgatttgtcttaatactgttgaaaataat

SEQ ID NO: 74902 - DNA, 405 bp, Homo sapiens
ttttttgagacagagtcttactctgtcacccaggctggagtgcagaggtgtgatctcggctcactgcaacctccgcctcccgggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcctcctgagcagctgggattacaggcgcttgctaccacacccggctgattttttgtatttttagtagagacggggtttcaccatgttggccaggctgg

SEQ ID NO: 74903 - DNA, 404 bp, Homo sapiens
tataaatggaatccaacaacacataaaaagatttgtataaaaattttcacatggtgatcttttcgtagttcataagtgtgatgactgggtattcatgcatgtatgtgggatatgccacccttgacccttgttacaacattagcacattaaccatctgacatgaaaggaaaaaacaaaacaaaaaacacacatttccatatgttgtattttcattttcattcatgatcaagtgagagttattccaggtatgcaagtctgcttcaacattcaaaaaatgaatcaggccaggtgcggtggctcctgcctgtaaacctaacgcttgggaggctgaagtgggaggatcccttgaagccaagagttcccttgaagccaagaccagcctgggcaacacagtaagacctggc

SEQ ID NO: 74904 - DNA, 541 bp, Homo sapiens
gttcacttgttccaaggtgttactcacttggccctgtggaaatgacagtcagggagcctgggtccaaggcctgtctctaatttgccaggtgatcttgcccaagtttctctctgcagctcagcttacccatctacacaaaggctgcaaattcagatgcttacagggcctgggcaactaatagaagtgtgtgcagtgtctgggaaggcagaggttttttaactgtcttgctctccagtgcctggtatgcagcaggtgctcaataaatacttgaaggcatgaatggggccagcataactcagctcctgctcactgttgccaaggaggccaattgttgtggccccacccttggatatctggggatttctgaaatctggactggtgtgaatctgccccaatttttaaatgtgaggccatttgaggtggctcatgcctggaatcccagcactttgggaggctgagacaggaggatcacttgagcacaggagtttaagaccagcctgagcaatgtagtgaaaccccatctccaccaaataaaaaaaaa

SEQ ID NO: 74905 - DNA, 666 bp, Homo sapiens
atccacgccccttggcctcccaaagtgctgggattaggattagaggcgtgagccaccgtgcctggccacaagtaatttttaaatggtgtgtgtgtgtatttagtttgctttttaaatgaacaatgatttggaaaaatcttaatccagtggcatgttactggcagtattttggattagaacgtgggctttcaagttaaatagacccattcatgtttggactccacctctgctacttaatagctctgtaatctggggcatgttacttaaaatctctgagcctctacaaccgtaaataggaagagtgagcctgcagtgaaggtaaacgtgatgcctaacttcgacgatttcatgtaaatcgcccagcatgatgtttggtgtatagttggtgctcagtattactccctctccccctccctcttttccctccttaactcaagttagctctttggtaccttacatatctcacttcatttcccaaggaaacaccactgtaaaacataattataaattgctgtacaaaataccttccctggaccttgtttgaaggtctttccttttatattgtatcccttttcttttttggaggtcagtaggaatggttgaggcagtcttgtgtctctgatgaatcaatcgctaaaacctacctgaagaaactaagaagttccc

SEQ ID NO: 74906 - DNA, 453 bp, Homo sapiens
atccacgccccttggcctcccaaagtgctgggattaggattagaggcgtgagccaccgtgcctggccacaagtaatttttaaatggtgtgtgtgtgtatttagtttgctttttaaatgaacaatgatttggaaaaatcttaatccagtggcatgttactggcagtattttggattagaacgtgggctttcaagttaaatagacccattcatgtttggactccacctctgctacttaatagctctgtaatctggggcatgttacttaaaatctctgagcctctacaaccgtaaatagggagggggagagggagtaatactgagcaccaactatacgccaaacatcatgctgggcgatttacatgaaatcgtcgaagttaggcatcacgtttaccttcactgcaggctcactcttcctatttacggttgtagaggctcagagattttaagggggt

SEQ ID NO: 74907 - DNA, 264 bp, Homo sapiens
ttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattt

SEQ ID NO: 74908 - DNA, 556 bp, Homo sapiens
ttaatactaaagatgcatttggtcagaaatatatattattagtttttattcagaattaatacaaagatataagatatcaaatatcaaaaagattttcttaatttagatatctgagccatagcaaatgtttatttgctaaatgttgatttgtagctaatgatattttggaataagaataatttttcatattaaaaatgaatgtttagattgttcatattgtagtgttttaatgtttctgtgttgttagaattctgcatttgatcattttgtaaaatagtacttaataaaaatatcaaagattcaaagaatttgattctgctacttggtaaattgcaagtttaattgacatataaatcatgaaaatacaaactctacttagaaaataatttttaaagtaccgtaattgttatatgaccttgaagttccagcaatctattgcataactcttcaagagaagtcacatggaggaaacctcatatttccttaaatttattagtgttccttggtggtctaaactattggggttttttttttcaaggtttcttttcaaagcaat

SEQ ID NO: 74909 - DNA, 627 bp, Homo sapiens
agtttcctgaagcctctcagccatgcttccagttaagcctgcggaacttttcaggagctggacagaagtttgtattacaggctcgtagcaccggaggtttctgatggagcagacaacttgaggaaggccggccttgctgaacacagtggactgaccgggtctggacccctcccccacaggtgactgtgcactgcagcagagagaagaggaaggagtcagaaacactctactgagatcctcccggatagataacgtacgtacatattgatacctctacccggactctgtgattaatggtgaggtggggagcacccgagtcctctgaactgaacagctgtgcagcaacatctgctgggtggaatgctggaaggaccgcgtcacacaccaatcctagctaaagtttcacccaagtcttctgaaaagaagggtgcctctagcatctgataagtttaaaagcgaagtatccttggctgaattgcctgacattctgagctttagggaccatactacccctgaataggagtacttagcaccgtgcatagtaatagcttgacaaatattagctattacattgttcagaaacatgatgtaagaaccaaatgagtaaaggctgtgagcagcatttct

SEQ ID NO: 74910 - DNA, 835 bp, Homo sapiens
tagtggcttataacattatgcatttattgcatggaaattcagaaatggttagctgtgtggttctggcttgaggtctctcatcaggctgcaagaaagattggaggtggggctgtagttatctgaatactcggctgggctggggaatctgcttctggaaggctttctcacatagcccagtggttgtcaggaaacctcagtccttcttcatggactgcttgaggaccatcacaacatggtaactggcttcctgcagaattttcaggagctggacagaagtttgtattacaggctcgtagcaccggaggtttctgatggagcagacaacttgaggaaggccggccttgctgaacacagtggactgaccgggtctggacccctcccccacaggtgactgtgcactgcagcagagagaagaggaaggagtcagaaacactctactgagatcctcccggatagataacgtacgtacatattgatacctctacccggactctgtgattaatggtgaggtggggagcacccgagtcctctgaactgaacagctgtgcagcaacatctgctgggtggaatgctggaaggaccgcgtcacacaccaatcctagctaaagtttcacccaagtcttctgaaaagaagggtgcctctagcatctgataagtttaaaagcgaagtatccttggctgaattgcctgacattctgagctttagggaccatactacccctgaataggagtacttagcaccgtgcatagtaatagcttgacaaatattagctattacattgttcagaaacatgatgtaagaaccaaatgagtaaaggctgtgagcagcatttct

SEQ ID NO: 74911 - DNA, 592 bp, Homo sapiens
tcgagctggtacccgttcccactcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74912 - DNA, 963 bp, Homo sapiens
  misc_feature (328)..(328): n is a, c, g, or t
  misc_feature (337)..(337): n is a, c, g, or t
  misc_feature (365)..(365): n is a, c, g, or t
  misc_feature (394)..(394): n is a, c, g, or t
  misc_feature (405)..(405): n is a, c, g, or t
  misc_feature (433)..(433): n is a, c, g, or t
  misc_feature (456)..(457): n is a, c, g, or t
  misc_feature (495)..(495): n is a, c, g, or t
  misc_feature (500)..(500): n is a, c, g, or t
  misc_feature (503)..(503): n is a, c, g, or t
  misc_feature (537)..(537): n is a, c, g, or t
  misc_feature (564)..(564): n is a, c, g, or t
ctcttttgggtctttcttcttgaattacaggggggtttgtagcttctctttgtagatagctaataaaatcacttaattcacggccaccttcatatttctttggatttagcttcttgtcggctggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgaaaaaatnaaaaacccnaaaataaaacaaaaaaagaacctagaanccaaataaaaaaaaaaatgaaaaaaaacnaaaaaaaaaanaaaaaaaaaaaaaaaaaaaaaaaaaaanaaaaaccaaaaaaaaaccaacannaaaaaaaaaaaaaaaaaaaacaaaaaaaaaaaaaaaancaacnaanaaaaaaaaaaaaccaaaaaaaaaaaaaaaaaacnaaaaaaaaaaaaaaaaaaaaaaaaaanaaaaaaaaaaaaaaaaaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74913 - DNA, 1959 bp, Homo sapiens
  misc_feature (168)..(168): n is a, c, g, or t
  misc_feature (234)..(234): n is a, c, g, or t
  misc_feature (263)..(263): n is a, c, g, or t
  misc_feature (413)..(413): n is a, c, g, or t
agcggaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttnttgccgcggcccgcctcgccgctgcctccgacgtgctagaactcacggacgacaacttcgagagtngcatctccgacacgggctctgcgggcctnatgctcgtcgagttcttcgctccctggtgtggacactgcaagagacttgcacctgagtatgaagctgcagctaccagattaaaaggaatagtcccattagcaaaggttgattgcactgccaacactaacacctgtaataaatatggagtnagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74914 - DNA, 1881 bp, Homo sapiens
  misc_feature (168)..(168): n is a, c, g, or t
  misc_feature (234)..(234): n is a, c, g, or t
  misc_feature (263)..(263): n is a, c, g, or t
  misc_feature (413)..(413): n is a, c, g, or t
agcggaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttnttgccgcggcccgcctcgccgctgcctccgacgtgctagaactcacggacgacaacttcgagagtngcatctccgacacgggctctgcgggcctnatgctcgtcgagttcttcgctccctggtgtggacactgcaagagacttgcacctgagtatgaagctgcagctaccagattaaaaggaatagtcccattagcaaaggttgattgcactgccaacactaacacctgtaataaatatggagtnagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggtactacgctttggcaggttaccgagctcg

SEQ ID NO: 74915 - DNA, 1168 bp, Homo sapiens
ccagttggtgcatagattaatcccgttttctccaggcaaaatcactttaggcgtatactgaccgctactatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74916 - DNA, 1848 bp, Homo sapiens
  misc_feature (168)..(168): n is a, c, g, or t
  misc_feature (234)..(234): n is a, c, g, or t
  misc_feature (263)..(263): n is a, c, g, or t
  misc_feature (413)..(413): n is a, c, g, or t
agcggaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttnttgccgcggcccgcctcgccgctgcctccgacgtgctagaactcacggacgacaacttcgagagtngcatctccgacacgggctctgcgggcctnatgctcgtcgagttcttcgctccctggtgtggacactgcaagagacttgcacctgagtatgaagctgcagctaccagattaaaaggaatagtcccattagcaaaggttgattgcactgccaacactaacacctgtaataaatatggagtnagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagtgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74917 - DNA, 1470 bp, Homo sapiens
  misc_feature (168)..(168): n is a, c, g, or t
  misc_feature (234)..(234): n is a, c, g, or t
  misc_feature (263)..(263): n is a, c, g, or t
  misc_feature (413)..(413): n is a, c, g, or t
agcggaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttnttgccgcggcccgcctcgccgctgcctccgacgtgctagaactcacggacgacaacttcgagagtngcatctccgacacgggctctgcgggcctnatgctcgtcgagttcttcgctccctggtgtggacactgcaagagacttgcacctgagtatgaagctgcagctaccagattaaaaggaatagtcccattagcaaaggttgattgcactgccaacactaacacctgtaataaatatggagtnagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgcgatccttctgcgaacaatgagcactaggatcagcacattatcgccgtatattagcgtagataccaaatatcatcacacgcaagatggatgatacagctaatgatagtgcctttctctatatgaaatcagg

SEQ ID NO: 74918 - DNA, 1431 bp, Homo sapiens
  misc_feature (168)..(168): n is a, c, g, or t
  misc_feature (234)..(234): n is a, c, g, or t
  misc_feature (263)..(263): n is a, c, g, or t
  misc_feature (413)..(413): n is a, c, g, or t
agcggaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttnttgccgcggcccgcctcgccgctgcctccgacgtgctagaactcacggacgacaacttcgagagtngcatctccgacacgggctctgcgggcctnatgctcgtcgagttcttcgctccctggtgtggacactgcaagagacttgcacctgagtatgaagctgcagctaccagattaaaaggaatagtcccattagcaaaggttgattgcactgccaacactaacacctgtaataaatatggagtnagtggatatccaaccctgaagatatttagagatggtgaagaagcaggtgcttatgatggacctaggactgctgatggaattgtcagccacttgaagaagcaggcaggaccagcttcagtgcctctcaggactgaggaagaatttaagaaattcattagtgataaagatgcctctatagtaggttttttcgatgattcattcagtgaggctcactccgagttcctaaaagcagccagcaacttgagggataactaccgatttgcacatacgaatgttgagtctctggtgaacgagtatgatgataatggagagggtatcatcttatttcgtccttcacatctcactaacaagtttgaggacaagactgtggcatatacagagcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgtgagttgctagttgggctttgattctccaaggcaattattaaagccttttatactacaaaggatttctaaagaacaataaccctggaatgtgaagataggtcttttaatcaagacctatgactgtcatttttctcaatttaaatataggtactttagaccaggcgtggtggctcacgcctgtaatcccagcactttgggaggccaaggcaggtggatcgcctaaggtcgggagttcgagaccagcctgaccaacatagagaaaccccgtctctactaaaa

SEQ ID NO: 74919 - DNA, 963 bp, Homo sapiens
ctcttttgggtctttcttcttgaattacaggggggtttgtagcttctctttgtagatagctaataaaatcacttaattcacggccaccttcatatttctttggatttagcttcttgtcggctggagagaagtttgtcatgcaggaggagttctcgcgtgatgggaaggctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74920 - DNA, 1005 bp, Homo sapiens
  misc_feature (6)..(6): n is a, c, g, or t
  misc_feature (25)..(26): n is a, c, g, or t
  misc_feature (45)..(45): n is a, c, g, or t
  misc_feature (73)..(73): n is a, c, g, or t
  misc_feature (75)..(75): n is a, c, g, or t
  misc_feature (80)..(80): n is a, c, g, or t
cccggnggtccttagattttgtacnntaattgccttctcttgctnagcctagttttggctccagcaattcagngnaagtngttctactgaggtccagtatcatacaatccagatagctccttgatggtcttgcttgggtcaaggaaactttgggctctatggtaaaatagtggaattcctttaggaatctctccatcttcatagatattatttttcacaggtgaactgtaggaaagtaccaagtttacagttagatattgggagtagtgtgattgaggtggagtagatttggcgtaggtttggtctagggtgtagcctgagaataggggaaatcagtgaataatgaaaataaagatgtgctgattgaattttatgccccttggtgtggtcattgtaagaacctggagcccaagtataaagaacttggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74921 - DNA, 612 bp, Homo sapiens
ctcgcgttactgcaggtgatctagagcgatcccgtccaaagcgagtacccaaatatcgtcttggcccagatggatgccgatagatgaatgatagtagccttctccgacatgaagtcaggagttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74922 - DNA, 873 bp, Homo sapiens
ttggcccatcgtgtggctgcccattgtgtagtgatgtctgccttctgccagggcttgtcggacatacttctggtgggcactgtgcggaaacttgaggatgaaatcagtgagctgcatggcacttgaaaggcatggcctgtctcctcacttgagtgcaaggtccatcgaccaaagccctgttctgatcaataacatctacaatcgcgaccaattttccggcatgaggtccaaaggagacataggccacccggccaacctccacgaagcgcctgaacaccatgttggcagcgttaggcgagaagctcagcaaagacccaaatatcgtcatagccaagatggatgccacagccaatgatgtgccttctccatatgaagtcagaggttttcctaccatatacttctctccagccaacaagaagctaaatccaaagaaatatgaaggtggccgtgaattaagtgattttattagctatctacaaagagaagctacaaacccccctgtaattcaagaagaaaaacccaagaagaagaagaaggcacaggaggatctctaaagcagtagccaaacaccactttgtaaaaggactcttccatcagagatgggaaaaccattggggaggactaggacccatatgggaattattacctctcagggccgagaggacagaatggatataatctgaatcctgttaaattttctctaaactgtttcttagctgcactgtttatggaaataccaggaccagtttatgtttgtggttttgggaaaaattatttgtgttgggggaaatgttgtgggggtggggttgagttgggggtattttctaattttttttgtacatttggaacagtgacaataaatgagaccccttt

SEQ ID NO: 74923 - DNA, 308 bp, Homo sapiens
ttttctcagcggtgggaatagattaacaagccttacccttgttttccaattgtaggcgtgatgggaaggctctggagaggttcctgcaggattactttgatggcaatctgaagagatacctgaagtctgaacctatcccagagagcaatgatgggcctgtgaaggtgaggtgctcacagcctcatcaagctatgagcaattgcctgtcctcatttctttgttccaaaactgtggggtctaaatgaagacttcgttggccatctctttttttttttgtccttactcccgagtcataaaataagcattgg

SEQ ID NO: 74924 - DNA, 905 bp, Homo sapiens
tcatcgctgtctggaacagcgatgactcgagagcggagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgacaaaaaaaaaaaaggggggcggtaaaaaatcccgcggggcccatttactacccttttgtaaaagggccaa

SEQ ID NO: 74925 - DNA, 1034 bp, Homo sapiens
caaacttcccaccttgcctcccaagtagctaggattacaggtgtgtgccaccacacctggctatttttagtagagacggggtttcaccatgttgtccaggctggtctcaaactcctggccccatgtgatccacctgcctcggcctctcagagtgctgggattacaggcgtgagctactgtgcctggcctgttccttatctttatcctcaccctgaggtacttgccacatccaccaattaaaattaccaggatagagagcccagttttaggacctcaggcaatttgggcctgagaacactagcctaagctctagcagtccccagctctggggattccttctgccttctacctacccccaagcatctcttcttcaaggtgctgcagaacccagattttactatcagagtctctgccaggtccatgaatgtatgtgaattctttctgctgcactgctgagagcagtccctgggcctggactttgacaagcagatagtggctttaattgaatccagatatccatcttgtctgtctgtggaggtatttttcccagctccccctccctacccctgatcagctgcccgctgagtatctgacagccttaagctttgagcccagcatggtggccaagccttggcgtgttggattccagcttagggacctggcatccatcttcagactccctgttccctaagccaggcagacctgcccccgctgggctgagagcaaagggacaggtcctataatagccaaagctctctttacctggtcctgcttatagcactggggtgggggtagggagcaacactgggaaccccaaggttttgtcttctcctcgggacatgtatcttcccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74926 - DNA, 464 bp, Homo sapiens
gtctgaagtattttgtattttgtggcctaggaggtgctccctgagtttgttgataggaggctagaagaagaggtcttgaagttaaaccttggagaaaggtgggatttggagaaattgagaggctcattaggctcagatgggtcagacctgaggcatccaggagagttgggggcaggatggaaatgtgcacctagagaagggggcagtggacagagtcactgtccaaagctctaggacctagccatctcccttgccaggtcctcaggcccttacatgggctgattagcaatgcccaggtttgcttcactgcaactatcttgtccatttttgctttagaggagcagtttatcctttcccaggttgcactcctggagcaggtgaatgccttggtgcccatgctggacagtgctcacatcaaaggtatctctctggggttatagcttcactactctggttggggaggt

SEQ ID NO: 74927 - DNA, 851 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74928 - DNA, 673 bp, Homo sapiens
catgaggtgttgaagccttgtttcactgagttggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74929 - DNA, 926 bp, Homo sapiens
  misc_feature (871)..(871): n is a, c, g, or t
  misc_feature (879)..(879): n is a, c, g, or t
  misc_feature (887)..(887): n is a, c, g, or t
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgacaacaaaaaaaaacaaaaccncggggatntatggggnggcgaaaaagggaaccaaatgcagctgcaagacggcaca

SEQ ID NO: 74930 - DNA, 920 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgacaaaaaaaaaaaaggggggcggtaaaaaatcccgcggggcccatttactacccttttgtaaaagggccaa

SEQ ID NO: 74931 - DNA, 767 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74932 - DNA, 882 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcagttcctttctgtgctacactttggccctacaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74933 - DNA, 640 bp, Homo sapiens
agaagaagagacatacactagggggaatgtttacttaatgtatggccactcccttttccatccgtctttggactgctgttagggcacccatcctggagcctgaaagtgctcccatagccatttgctcctttggctttggggttaagcgtcatcttttttaggctccatggggagtgggagtccgtgatgaggcaggaagtttagtggaagatgtgggctttgcccagttcctttctgtgctacactttggccctacaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74934 - DNA, 821 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcagattcctattctcaccttgacctacaaccagacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74935 - DNA, 810 bp, Homo sapiens
agaagaagagacatacactagggggaatgtttacttaatgtatggccactcccttttccatccgtctttggactgctgttagggcacccatcctggagcctgaaagtgctcccatagccatttgctcctttggctttggggttaagcgtcatcttttttaggctccatggggagtgggagtccgtgatgaggcaggaagtttagtggaagatgtgggctttgcccagttcctttctgtgctacactttggccctacaggaccagtgtgtggaaatcactgaggagtccaaggctctcctggaggaatacaacaagactgtatcctttctgctcaactaggaccctaatgggtgctgtccctaagccctgtccttttgttccacctctagctctctctcatcctatcctacccacctatgtttgcctgttccccactttccatgaacttcctcactcagattcctattctcaccttgacctacaaccagacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74936 - DNA, 851 bp, Homo sapiens
ttctcagggtttgttataattttttatttttatgggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74937 - DNA, 948 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggctccatggggagtgggagtccgtgatgaggcaggaagtttagtggaagatgtgggctttgcccagttcctttctgtgctacactttggccctacaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74938 - DNA, 940 bp, Homo sapiens
  misc_feature (938)..(938): n is a, c, g, or t
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgactgtgaaaaaaaaaaattccggggatcgcaaaggcgactcgaggggccgaccttgcctaggggagcggggcccgtgtccggatgcccnag

SEQ ID NO: 74939 - DNA, 621 bp, Homo sapiens
ctccaggagtgcaacctgggaaaggataaactgctcctctgctaggatgaattgcagcttagaggcatcaggtatggcaatgcggtcgatgtactcaggatccaggtacttgatcagatcttcaatctttttgtagagaatcttcaccctctccctcttgctggacagtgctcacatcaaccgttcctgagcatgctgcccgcctgcagcgcttggcccagatccacattcagcagcaggaccagtgtgtggaaatcactgaggagtccaaggctctcctggaggaatacaacaagactacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74940 - DNA, 1021 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccaggttgcactcctggagcaggtgaatgccttggtgcccatgctggacagtgctcacatcaaagccgttcctgagcatgctgcccgcctgcagcgcttggcccagatccacattcagcagcaggaccagtgtgtggaaatcactgaggagtccaaggctctcctggaggaatacaacaagactgtatcctttctgctcaactaggaccctaatgggtgctgtccctaagccctgtccttttgttccacctctagctctctctcatcctatcctacccacctatgtttgcctgttccccactttccatgaacttcctcactcagattcctattctcaccttgacctacaaccagacaatgcttctctccaagcaattcgtgcagtgggatgagctactttgccagctagaggccgccacgcaagtgaagccagcagaggagtgatagctgctccccatcccaaagtgggcctgggcagtcaggctccagggccctatgccaacctgcctttgttacaaggcagaggaagctttgtatttattggcttcaaggcccacctctctgtactctgggctctaaagttggaggtcaggttacctgaggtttgcaatttgcaacacccaccctccccccaatcagtgttcttatttcagtgacaataaaccatagagatgac

SEQ ID NO: 74941 - DNA, 559 bp, Homo sapiens
aaacataggctaggtacgaggccggtggtgaatcggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcaggtaatgctggactacatgtgtacatgcatctgaggatgtgggtcgtcggggaggttaagcacagagatggcctctccatccagtcttctggtggatacaagccctggatgctgctctctggaattgtggcctggttctgggttgaggatcctatggatcctctagtagacattgagtacagtatacctctgcaccagctgcaggccatggtgccagccacagtgggagctagt

SEQ ID NO: 74942 - DNA, 658 bp, Homo sapiens
tgtttatgttggtattcattataataactgggatcagcccttataatactcttttccttttcctcacccagtataagttattgtattggtgagcatttattatactttattttcttttgtggaagtaatttgatatcttgtactggtgacctgtctttttccctaccttgactgtaaagaatttagtaacatttattaggaaaatgagttataatttattaggtgtatataaatgggctagcaagaaaaagatattctttatctgaaatctgttttaaaaagtactaagaattattccaatttgcttttagtagaagcagtatatttcttttaaggaaattgtcttatataatttacttgaatttttatttattaaagttatgtttggaaacttatgttgtaaccttcagtctactggggtagaattctgattgaggtagttcccttagagcttatccaagatactgttaggtataccctctgtttcctgtggttctgaactcttactttatcctaaaatattctcaagtttctcctgttttaaaagtacaaaacttttttttttggcaaatctgtagaggttctctagctaccactttgttttccttttccatttgccaaaatgcttcttgaaaaactagtataacttcttgtctcc

SEQ ID NO: 74943 - DNA, 1023 bp, Homo sapiens
  misc_feature (384)..(384): n is a, c, g, or t
  misc_feature (432)..(432): n is a, c, g, or t
  misc_feature (487)..(487): n is a, c, g, or t
  misc_feature (489)..(489): n is a, c, g, or t
  misc_feature (623)..(624): n is a, c, g, or t
  misc_feature (992)..(992): n is a, c, g, or t
taattatactttaagttttagggtacacgtgcacactgtgcaggtagttacatatgtatacatgtgccatgctggtgcactgcaccactaactcgtcatctagcattaggtatatctccctcttctatctgttacctttgccattagttctgacagtgcagccagatctgtgggtatatgctagatcaaaaagaaacacttttaaactgtctcttgagggaacacttattttagggatcagtgaaagacagtgagctgagcactaacatctacagttaccattacaggcttcagaattttgaggcagcagtcaacatcaagaaggtatccagaggtagagcagagaaaaatattggatggtcatgacagtcaagtgtttttttnctgggaatatttgagatctccccggggtactttctgaaatatgtgaanaattttgaaagggaggctagagtgtcagcaatttctatggcggataataaaaatnancaaataacacaactgaaattattgccaccccacctcttgattagtatggcctgaaacataatgatatatctcttatttaagttcttcatcacttgttatacttgcttgaatctctgacataaagcacagttctnntcaatttgctttgagattgcaacatattcaacagctaatattagattttataaatctaattctattattctccttaactaaaagagctctaaatatctatcacatccttaacaataataaatattttggtaacaaatatgggcttgaaatagttgttggtattattagaaacaacaccaagaatttaaaagcaaacaataaaaagtttctattttagtaagttttatttacaaattataaaacaaagcctaacaaatcataccactgaagtttttagtgtataggaagttcaattaccaaagatccttgactttttagatcaaggtttaaaaggatacttggtgtattagtccatttttatgttgctnataaagacgtactcaagactgggcaatttac

SEQ ID NO: 74944 - DNA, 301 bp, Homo sapiens
atatgatgctttcttttgtaatttgaaaaatagctttatctataagtgagctgaactgtttgtgtgtgtgtgtgtgtgtgtgtgtatacatagtcatgcattgctttacaataggaatacattctgaaaaatgtgtttttaggcaatttcgtcattgtgtcaacaccatagcacgtacttacaaaaacctaggtggtataacctattacacccctaggctacaaacctgtatagcatgttacagcactgaatactgtaggcagttttaacacagtggtaagtatctctgtatctaaacaga

SEQ ID NO: 74945 - DNA, 391 bp, Homo sapiens
attttgttgaggtccagtttgggtggcagaaactaagacactgagctgatgagagaacttgttgcttttcgccctgcgcatttatttatttatttatttatttatttttgtatttttagtagagacagagtttcaccatgttggccaggctggtctcaaactcctgacctcaaatgatccacccacctcggcctcccaaagtgctgggattacaagtgtgagccaccatgcccggccacctgttgcatctttaacagctgtgtttggaaaagggtgaggaattgattcatcaatattcaatactaagctgcaaaatcaggaatgcagccaattggtttaattgatcaagacttataaactcttaaggactctagtgaactgatacaaacta

SEQ ID NO: 74946 - DNA, 618 bp, Homo sapiens
aagggactgtatatagagatgctttaatcccatctcagtggttctcaaagagcagttccctggcatcacttgaaagcttgtaaaaaatgcaaatccttgggctccatcacaagcctttcaggggattctgaaaccatcactctaatgcttacaacaattctgcaaggtctacattattacccagaatcctcaaatagaagcagagggcagctcagagaggttaagtgaacttttcaaggtcacacagccaacaaagggtaaggacagaaatcaaattcaactccggttctggttaaaaagctaatgccttttatagttagcttcaaagaaacttaataaatatctactttaccttaccttatcttacctaaacacatacacacacacagtcttgaaagacatgaggtgctctcttcaaaaaacatactagatgctacacgctagactagaagtttgggtattacaaacacaacttaactgggggaaaccttatgaaaggaagctgggaaaaacaaaaaagggaaactttctgcaactctacaccatgtggtggaggtttctgttgtctggcacctacgccccattctgggggtaatctcgtgccgaattcggcacgag

SEQ ID NO: 74947 - DNA, 618 bp, Homo sapiens
aagggactgtatatagagatgctttaatcccatctcagtggttctcaaagagcagttccctggcatcacttgaaagcttgtaaaaaatgcaaatccttgggctccactccagacctactgatttggaaactcagggggtgggttctggcaatctgtgttttcacaagcctttcaggggattctgaaaccatcactctaatgcttacaacaattctgcaaggtctacattattacccaaggtcacacagccaacaaagggtaaggacagaaatcaaattcaactccggttctggttaaaaagctaatgccttttatagttagcttcaaagaaacttaataaatatctactttaccttaccttatcttacctaaacacatacacacacacagtcttgaaagacatgaggtgctctcttcaaaaaacatactagatgctacacgctagactagaagtttgggtattacaaacacaacttaactgggggaaaccttatgaaaggaagctgggaaaaacaaaaaagggaaactttctgcaactctacaccatgtggtggaggtttctgttgtctggcacctacgccccattctgggggtaatagctctctattttcatttgag

SEQ ID NO: 74948 - DNA, 459 bp, Homo sapiens
ctaagcactccacagccacatcctagatctgcagccactttattttctacctcatcacatgtgttatggattgtatagagcatacgtgcttcactgtgtagttcttttctttccgtgtggatatccagtaccatttgttgaaaagacttccctttctttattgaattgctttggaatcttcaatgaaagaccatttaacccagcactttgggaggccgaggtgggcaggtcacaaggtcaggagatcgagaccatcctggctaacacggtgaaaccccgtctctactgaaaatacaaaaaaattagccggtcatggtggcgggcgcctgtagttccagctactcaggaggctgaggcaggagaatggcgtgaacccgggaggcagagcttgcagtgagccgagatcacgccactgcactccagcctgggtgccagagcaagactccatctcaaaaaaaa

SEQ ID NO: 74949 - DNA, 2379 bp, Homo sapiens
cagaattgaagtattcctctaattcctgctgattccctaaactacaggtatttttccccttttcattaccaaagattggaacacacaggaaattgaaagaataaaacgaacacccctttctcgatttagattaacaatcagaataaagaggccaggtatggtggctcacacccgtagtcccggcactttgggaggccgaggtgggcagatcacttgaggttaggggttcaagaccagcctgaccaacatgaagaaaccccatctctactaaaaaaataccaaattagctgagcgtagtggcacacacctgtagtcctagctactcaggaggctgaggcagtagggtcaggaggcagaggccggagttgaaggctgcagtgagctatgcgggtaccactgcactccagtcgggtgacagagcgagaccctgactaaacaaaaaataacaacaaaaaaggaggcaggggtttagaaaataccatgattgttaacaggaccatcagatttcattttttctaaaatattagatattgtcagtgtggtttttatataggtgctgattctgttctgttcgtcttcaagtaacaaatgcctgcagtggagatatcttattttgatgattaacaggaagcttttaagctttgaagaaagcaaacaacattttccatggacctttaagagctgggctaatatttttgcccacacagaactctaattcatttcagagtcaagggcaacaatagaatactttttcaaggaccttgcatttgttaatacaggttttcataatagaaagcaatttaaatattcagaactaacgtaacatggaagaaacaactttttcctgaaatatttgagagacaaatataacaaacaattcatctttactatgacaatctcaacggaaagacttcagtgtggtcatattaatgcattttctgttcccagcaggcaagtaaggcaagggaagcatcagctcccaggctattgtagtcatccagatggagatgaggtaggctcagatggcagtggtgggagcagggagaagtagttagaattcagatgtagttttaagattgagccaacagggtttgctcatgaattgggcagaggatatgagggaaagagaaaactccatcttggaggatggagttactgtttcctgagatgagcaagcctgtaggagcttcaggcgtggagcactaggggaacatcaggagtttggcatggcatgatgttaaaaggggaatgtctattagacatccaagcggagatgtcaaggaggtggctgaaaatatgagccttgagttcagggaagaggttcaggctcttatttaaggtgctgagacccattgagatgaccaggaggagagcgtatagacaggaaagtttgagaattgagagtcctgggtcgctctggcattaaaaggtggataatgagaagaagtttaaggaatggcagtgaaggaggaggagagtcagtaggttgtgggtgtcctggcaacccagcaaagaaagtgcttaaagaggagagtgatcagctctgtctgtgccgctggcaggtccagtaagaggaagactgaacagtgaacattagattgagtgaaaatggtttctgctgcttttttgcccaagtagtcttgaatgaattcagttaacctgtctctggggataacaatggtacttacctcatcaggtggtggtgatgaactgtttatttatttaaaaaaaattttttttgagacagggtgtagctctgtcacccaagctggagggcattggcatgatcacagctcactgcaaccttgacctcttggactcaagcaatccttccgtctcagcctcctaagtagctaggaccataggcatgcaccaccacacccagctaattttttattctttgtagagaaggagtcttgctatgttacccaggttagtatcaaactcttggactcaagcaatcctcctgccttgacctctcaaagtgttggcattacaggtgtgagccaccatggccagcctatgaactgtttaagtggatgaccagcctaggcaagaaagatgccatctcttaaaaaaaaaaaaaaaaaaaaaagcaaagaaaaaaaaaaaaagctggatgttgtgccatgtgcttgtggtctcagcctcctgagtagctaggaccataggcatgcaccaccacacccagctaattttttattctttgtagagaaggagtcttgctatgttacccaggttagtatcaaactcttggactcaagcaatcctcctgccttgacctctcaaagtgctggcattacaggtgtgagccaccatggccagcctatgaactgtttaagtggatgaccagcctaggcaagaaagatgccatctcta

SEQ ID NO: 74950 - DNA, 367 bp, Homo sapiens
tgaggccagtactactctgataccaaaaccagacagagacaattcaagaagtaaaaactactgaccaatatccctaataaatataaatgcaaattcctcaagaaaataataggaaatagaatccagcagtatataaaaagcatatattatgaccaacaggaatatttcccaagagtgcaaggcttatttaatatctaaaattcaatcaatgtcatacaccatattaaaagaataagaaaccaaaaccacatgaccatctcaaaagatgaaaaaaaaaatctgaaaaaattccaggccgggcacggtggctcacgcctgtaatcccaacactttgggaggccgaggtgggaggatcatgaggtcagga

SEQ ID NO: 74951 - DNA, 330 bp, Homo sapiens
tacctaggcacgggttgaaaagaaaaacctctcccttgcttcctactgctctaattacctggtgtttcttcctttttacctttccttgggggctttagggtagttttggataggaggaaatgaagttcagcaatcggttttgcaaaagatgccagtgcattgacattctgatgtagggagatgtatgaattctataaaaataatttaaacagtcaaagtcaacagagtatgaaggagtatgagtgggacaaggaattgctatattttagtcataagccttagtaccatttgactttttaaaatatatgcatgcatcatataatttttaat

SEQ ID NO: 74952 - DNA, 248 bp, Homo sapiens
tgcaggctgtacagaaagcttggttggggaggcctcaggaaacttattcatagcagaaggcaaaggggaagcaagcatgtcttacatggtgggagcaggaggaaaaaagagaaggggcaggtactatacagttttctttataaattacccagtctcaggtagttctttatagcaatgtgagaacagactaacacagaaagcatggcagcatttggtcattggtaaattctcgtaacacagataaatat

SEQ ID NO: 74953 - DNA, 291 bp, Homo sapiens
taaggacgctcagtgcccgcttcctagtgagcttgtgaggagtagttgagataatgcttgagaagctcaagcagaacccctgctttgtactatgcaggctgcacacctgtgcttggattaatccacagttgtttgcatcgagatgagcaagcaggaaaaagatgttttggcatcagctggtggtggcattgggtcagagttacagtcacaacagtgtcaatctaggtcaggaaggtttaaatgacacaggcttggcacttatatgccactcaggatagatgagtcccaggg

SEQ ID NO: 74954 - DNA, 357 bp, Homo sapiens
agaccccttaataaacagggaaaaacgtcgaagtaccgttatttctctaagtaggttaagaaggttttgagcatctattttgtgctgatttgaacagtggggctataaaaatgacaaaaatacagagattgtcaccatgccacaaaatagaacaagagtgtgagcagatagataaccaattataacataatatggtaagtcctgttacataaatatgcccatagagagaggcttgggaacatgaaatggtcaggcattgggaaaggcattttgtaagtgaattttgagtcatatttaaagggtggatatgtttaaagggagacaggtaaaggcgtttaaagcaatgtaggcaatatg

SEQ ID NO: 74955 - DNA, 411 bp, Homo sapiens
agtaccccaatcaccccaaaaaaggagccaatgtttttcaacaatgaatgtcaagctggcaggaaagggctgtggccaagtatctgccatatcatactgcaattgtttgctgtctcctgatcatgctggaaagaatcttgtgtttcccagtgtctgatttatggtcctgctaaatgtctgtgcattgtcctagaatgaagaggctacactacctaccactcctactgcctctgtctctaggagtttttgccaatttcagggtgcaattacttgtagggtctggttggtcgtgtgcccttgtttttatgatacctcttcttaaggaaggcaattccaagccccgtacaattattgcaaccagaactggttgcctagttaagcccactcagtattgatagggcttttctttgg

SEQ ID NO: 74956 - DNA, 488 bp, Homo sapiens
aatattttcaaatgaactccaaagtgatatgtattgaagtcttgctcttggtctaatctgcctcagtcctgagaagcctagctctaagataaacaaagggcatcttccactgggagtgcaatgttggaactgctcactgccttaagtaaccatatgcatagcctctttcctgatagttggctcctgtctccctttgtaatcctttccttcttccatgcctgctgcttaagttgcagactattccagcctcacttctcttggacacttctatctgttgcaggcataggcctgtctcatcccagactcacctcttctacaagatcctccctgtaaatatctcctttgtgtttgctggatcatcttatttggttatctttggcgatggaggtggtagtgcttattactgagagttttctatgtaccaactatagtgtcagcagtatgctttatctgatttaattctaacaaccacctcatgagttagatgc

SEQ ID NO: 74957 - DNA, 337 bp, Homo sapiens
ccaaagctcaacatcatgtaatattcccatgtaacaaacctgccacatgtaccccctgtatctaatgtaaacattgaaagtaatctctctatatataaatataaactgatacatatatatatgaaaaagaatgtatcacgcaaattcttagaaacttggtaatagattgtagctcataagtagatttgtcacaggatttggggaaaattgaattatacaaagataatttcagataaatgtttatgagataaaaattataaatatgcttaaataggaatgggcaggtaggaagggagaattgatactgtatatatttaacttagttaagatagaagat

SEQ ID NO: 74958 - DNA, 409 bp, Homo sapiens
ttaaacccgtcgggctaccccttcaagtattcagaacagttttcccagctgttagttttcaagtgtcttttagaacgacagtcattttccattcatcttccatcttcctttggattgcgggagggcagccacacgcatgcctttggtttgcttatgagactggaaacagcacgagctgagctggatgatcccagccacagcccctcattcacggcactgtttgtctaatgatgataaaacatcctcatctgcccaacatcaggactctgccccagttctgcacacagcatgttgtgttaccaaatgtggtgtctgcacctctgggtatcgaatttcccaaacagctttcataaattttaattcatgaggaaggggtgtacacaagctaccttttgaaactgtaccagtc

SEQ ID NO: 74959 - DNA, 493 bp, Homo sapiens
aaattattcacacggtgtaaaaaagcccggtgggaaagtacactgtggtttccgtctctggccctgccacagggaaggaaactggaacacaccggtctggtaggaagaagagggattcccagacctacagggtgcgtcggcgataacccgacccaccaaagcccgaggtgctgccagtgcttccggccctgcgctgggtcagcctgccttaggggcaggaaggaccttctgtgacacaggctgcgggcagtacaggaaggtagcctctcagcaagaaccccaccaacaacagcaatagtagcaactgtagcaatcagtgagcacgttctcggtgccagacagggcaggtgtgaacttatatcattctcacaaagccctataaggggccaggcacagtggctcacacctgtaatcccagcactttaggaggccgaggccaaagggccgtttgagcccaggagttcaagaccaccctgggcaagaccccatctct

SEQ ID NO: 74960 - DNA, 568 bp, Homo sapiens
gttaacccaattagcccattgatttttttcagaaaaatatgtataaataacaagtacacaggtatttggtattgtagtaagcaaggaacaaatgtagatttgctatttttatggcaaaattatattggctgaacatccattttggtaagaaattacatattgttgtttctgtataattttaatgttgcagttcataagccagaaaaatttaatttgtggacttaatgtggagtttctttataacatagatttatatgttgattttttaatttaaaaagttcgatttatatgatatgaaattatttgattttttttgagaaataatttttaaagtcattttttggagagggtgtggatcccgttgacaatctgaattctatagcttctctcaaaaatgtagatattcaaaactttgtataccagttcaggggttctcatgttaaacagttgtccatggcttctattaagagctctaggtacatatgctctgttgtaaaatattattactctttagtaagtggcctaaggcaagtcatttgagattttaaaacccatttcctcatctcca

SEQ ID NO: 74961 - DNA, 457 bp, Homo sapiens
  misc_feature (2)..(2): n is a, c, g, or t
  misc_feature (7)..(7): n is a, c, g, or t
  misc_feature (54)..(54): n is a, c, g, or t
cnaaganaactctttgctgggggagggagagccctgtgaaatggtggaatactngcagcaatccctgtctggtacctactacaatacccagtagctcccctcccaattgtgacaataaaaaattcctcatgctgggattacaggtgtgagccatcacatctggccaacaccatttttaaaatactgtgctttaatccttgctgatccccactagatgccttttcttcttagagataacctggagtcagaatattataattgaaaggaagcttagggattattacttcactccagcgtgagagagaggtgaaatgacttgctcaagccgagtcacacagtgacttagaatatgtgtgatatgtcccctgtaggaatccccagacttcctttcctgacatacgtgagctgtctgacgcatagtaagtacgactgctcaggcacccatgcacatcacagg

SEQ ID NO: 74962 - DNA, 120 bp, Homo sapiens
ttcagtacaggagcagcccagtaatagtcccgatcgctaataagagcacaaacacccgtaagcaggtgaattggaaatattgtcattttgactacatcaacaacttataacttaccaaag

SEQ ID NO: 74963 - DNA, 609 bp, Homo sapiens
gacaagtgagaccacaaacaacaaaacataatgaatggatcagagcctgtgtataattggccctgaattaggcaaataggctttccccactcccttaaaatgaaaacaaaatggtagtttaaagaaagtaccaaagggactatatctaataataacaatgagattgaaaatgagggcacatggtgtgtttagggacggctgaggccagtgaatgtcaaggcagactgcatctttgacagcctcgcctcactggctcctgaaatcctcacacacaaaacagcattcttcttgcgttcttaaagtgaaaggcactgtttccctgtcacactagcaatgttgcgaagtaaatgtcatcctttcctcctccttggccctgccttctacagctagtgcccctgccagttgtttcctcagcacgtctccagcgttcctcttctcttcccccttggcacggccttacttctggtctcatcatcctatgcctgggctgatgcctttgcttcccagctgcagtcggctggggatgaatgtggggttaaggcaggcattccagatatttatagaattgttcatggttcttttcccattagccatgagttacttgagggt

SEQ ID NO: 74964 - DNA, 347 bp, Homo sapiens
atatgggaaaaatatagattcctaccttccaccataaattactatttttaattgttattttaatattttattttatcaccttttaagttattgggtacatgtgcaggatgtgcaggtttgttacatagggaaacatgagccatggtgttttgctgcgcagatcaccaacccatcacctagatataagcccagcaccaatgagctgttcttcctgatgctccccctttccctgcccacacccgataggccccagtgtatgttgtttaccctgccccaaccatgtgtccatgtgttctcatcattcagctcccacttataagtgagaacatgcagtgttgggttttctg

SEQ ID NO: 74965 - DNA, 479 bp, Homo sapiens
gctactttttctgtgtgtgaaaggattaaagcagagggaaactcattatcgtgactcttgaagattaagtgacctgtttgggaatttggctatctctctctcctgctttctcttgagacaggaataatacagggtggttgcaagagaacagaaaattccaggcagcagtttcacatgcctagcaaaatgaaactgttgaaatagctccataaactggggactgataagaccatgaaaaacaggatgtgggccaagctggctaaaaccaactggacccaacagagagcaggatttgacctaggtttctcctaggacctcattattcacccattaataaacaaatcgcacacccacctacactgtgacaagaacactgtatttggtgttaaaatgggcagcatcacagttctgagaaatcttcacctttttccaggaatcttcatgaatagtccaccccttgggtaaagaaacccatataa

SEQ ID NO: 74966 - DNA, 390 bp, Homo sapiens
tgagaagttttggtgaaaatggtgcattaaaaacctgtagtgtttgcattacagaatatacagaaagcaacaaacttcgtaaactaccttgttcccatgagtaccatgtccactgactgcatcgatcgctggttatctgagaattctacctgtcctatttgtcgcagagcagtcttagcttctggtaacagagaaagtgttgtgtaattaagatctgaactcttagctatgtagctgatatagtgatgggcaaacaggaatcacttgcttttatgtccactttttgagtggtacttaaatgtaaagtaacaacctgaattgagtcgttgctttctgaggtaatcattgtcctttctccagtttttgttccagaataaaaggaaatatttt

SEQ ID NO: 74967 - DNA, 378 bp, Homo sapiens
gcatgttactggccctaagttgtttattatcctgtagcacatccatggagcttggcaatagccaccaattccatcatcctcatagctactactccctccatacatctcaagtacctggcacattgtgcccttagagtatccagttctactggtacattctcccaatttgctgccatttgtctgtgctctgcccacctccactaatgggatcctcatcatcagatgggtggtgatccagttccaaaccccatcttaccatctcctttctcatctactttggtagcaactgtggaagaccagattctcaagaaggagatgctgagatagagtttgggaggcaaaatgtttattaaggacccatacctgtgaaaggaagga

SEQ ID NO: 74968 - DNA, 723 bp, Homo sapiens
taatgaatggttaaaaatataacccttatttttaaccattcattacagacaaaccagtaagagggatgaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttttaaacagacagatgaccacaaacaacaacaaagagggg

SEQ ID NO: 74969 - DNA, 2785 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattcttt

SEQ ID NO: 74970 - DNA, 1831 bp, Homo sapiens
  misc_feature (9)..(9): n is a, c, g, or t
  misc_feature (23)..(23): n is a, c, g, or t
  misc_feature (25)..(27): n is a, c, g, or t
  misc_feature (29)..(29): n is a, c, g, or t
ttatcgtcnggcggggcgcaggngnnngntaaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattcttt

SEQ ID NO: 74971 - DNA, 2440 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtaggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattcttt

SEQ ID NO: 74972 - DNA, 1645 bp, Homo sapiens
ggagggagtgaacttgctgattctgtagcaaaacctgggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattcttt

SEQ ID NO: 74973 - DNA, 1620 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattcttt

SEQ ID NO: 74974 - DNA, 3922 bp, Homo sapiens
  misc_feature (3816)..(3816): n is a, c, g, or t
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaaccattttttaacttcttgtcactgttcaattcctaaggtctagttcttgccagttttttttttttttttcctgattggcagggcttttaaagaagtaagaagaaaggttaagattattaggctaggttatagctgctcagtagtcattttgacaaagggtagcggatggttggtacaaatagtgttatatcctctatgacaaacggggtggatgtttttacacattgaggtaatacatagtcaaatcctttgctctcaaatagttgtacactttccatacatttctgtcttattttttaattctagtgatacacaaattacatgtgggctacttcatttggtaatttggtccagctttttggtggctgtagagtggcctctaggatacagaaaatgattctctgaaatttttcgttgtaattgttaaatactactctgcttgacttactcagttttggtgggaagatctgggtcaattggaatagtacacctttctcagggttttcagtttaataaggttgtcatattattcccaacatgggaatatagtggcttctaaagtttgcaaatgaattatgtaaaaggattttctgtgtattaggaaggcaacctgttctgttcatggtatattaacacttcattgtcatgtgtctacccttaaaattgctatttgtagtgaagaaaaaagcatagtggtatttagtcacttctgggttcctcttgtcagtttatatgcaaacattttggcatgtgggacttggggaggaggggctggggtgaggggccaggccatggccaagggccagctgcccctcatttatcactctgaccttcacagggnacagatctgatttatttatttcggttcaaaaaacacaacaaccacggaccagaaacaactttgcattgccattgggtttgacccataaactaagttatttcccgtg

SEQ ID NO: 74975 - DNA, 1048 bp, Homo sapiens
tcctacgagcgcactcctacgagcgcaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattcttt

SEQ ID NO: 74976 - DNA, 1750 bp, Homo sapiens
  misc_feature (1515)..(1515): n is a, c, g, or t
  misc_feature (1650)..(1650): n is a, c, g, or t
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagccccctctttcctntccttcttctcctccctcctttcctcttctctcttccctcctcctctctccttcccccttttctccccttttttcctcttccctcttctccccctctctcttctcctcccccttccctccctccttccttcttcnccctttttctcttcctcctcttcctcttctcccttcctcttttctctctcttctcctcttcctcttcttttctccttctttcccttctctctcttcctcc

SEQ ID NO: 74977 - DNA, 1501 bp, Homo sapiens
accctgcaggattgcgagcagtagcccattcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaaccattttttaacttcttgtcactgttcaattcctaaggtctagttcttgccagttttttttttttttttcctgattggcagggcttttaaagaagtaagaagaaaggttaagattattaggctaggttatagctgctcagtagtcattttgacaaagggtagcggatggttggtacaaatagtgttatatcctctatgacaaacggggtggatgtttttacacattgaggtaatacatagtcaaatcctttgctctcaaatagttgtacactttccatacatttctgtcttattttttaattctagtgatacacaaattacatgtgggctacttcatttggtaatttggtccagctttttggtggctgtagagtggcctctaggatacagaaaatgattctctgaaatttttcgttgtaattgttaaatactactctgcttgacttactcagttttggtgggaagatctgggtcaattggaatagtacacctttctcagggttttcagtttaataaggttgtcatattattcccaacatgggaatatagtggcttctaaagtttgcaaatgaattatgtaaaaggattttctgtgtattaggaaggcaacctgttctgttcatggtatattaacacttcattgtcatgtgtctacccttaaaattgctatttgtagtgaagaaaaaagcatagtggtatttagtcacttctgggttcctcttgtcagtttatatgcaaacattttggcatgtgggacttggggaggagggacaattggttgtatgttttgaccacttccacctatgaaaattatctgaacattattcagatttaagagttcatgggagcaggtggtacagaacctagtgttgaatataatttttgtgccatgcttgaatgtattttgacggattagcaaaataaaagtgaacctcctatttttcatcttaatgtgaagatcttt

SEQ ID NO: 74978 - DNA, 1484 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatcatgtgtagatagctagactatgcaccatagtagtactgcctcgcttgcatgc

SEQ ID NO: 74979 - DNA, 1420 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtaggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctag

SEQ ID NO: 74980 - DNA, 1765 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctag

SEQ ID NO: 74981 - DNA, 2793 bp, Homo sapiens
  misc_feature (1410)..(1422): n is a, c, g, or t
  misc_feature (1441)..(1442): n is a, c, g, or t
  misc_feature (1444)..(1444): n is a, c, g, or t
  misc_feature (1447)..(1448): n is a, c, g, or t
  misc_feature (1451)..(1451): n is a, c, g, or t
  misc_feature (1456)..(1456): n is a, c, g, or t
  misc_feature (1458)..(1458): n is a, c, g, or t
  misc_feature (1465)..(1465): n is a, c, g, or t
  misc_feature (1473)..(1473): n is a, c, g, or t
  misc_feature (1482)..(1482): n is a, c, g, or t
  misc_feature (1487)..(1487): n is a, c, g, or t
  misc_feature (1490)..(1491): n is a, c, g, or t
  misc_feature (1508)..(1509): n is a, c, g, or t
  misc_feature (1517)..(1517): n is a, c, g, or t
  misc_feature (1525)..(1525): n is a, c, g, or t
  misc_feature (1553)..(1554): n is a, c, g, or t
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaatagnnnnnnnnnnnnnccaccacaataatataatnncncanncantcatnanagacaanataacaanaccgaattngaaantcnncgtaaaacagactaacnncatagttntatttacnttataatatttttttttatatttatatnnttgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattcttt

SEQ ID NO: 74982 - DNA, 3939 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaaccattttttaacttcttgtcactgttcaattcctaaggtctagttcttgccagttttttttttttttttcctgattggcagggcttttaaagaagtaagaagaaaggttaagattattaggctaggttatagctgctcagtagtcattttgacaaagggtagcggatggttggtacaaatagtgttatatcctctatgacaaacggggtggatgtttttacacattgaggtaatacatagtcaaatcctttgctctcaaatagttgtacactttccatacatttctgtcttattttttaattctagtgatacacaaattacatgtgggctacttcatttggtaatttggtccagctttttggtggctgtagagtggcctctaggatacagaaaatgattctctgaaatttttcgttgtaattgttaaatactactctgcttgacttactcagttttggtgggaagatctgggtcaattggaatagtacacctttctcagggttttcagtttaataaggttgtcatattattcccaacatgggaatatagtggcttctaaagtttgcaaatgaattatgtaaaaggattttctgtgtattaggaaggcaacctgttctgttcatggtatattaacacttcattgtcatgtgtctacccttaaaattgctatttgtagtgaagaaaaaagcatagtggtatttagtcacttctgggttcctcttgtcagtttatatgcaaacattttggcatgtgggacttggggaggagggacaattggttgtatgttttgaccacttccacctatgaaaattatctgaacattattcagatttaagagttcatgggagcaggtggtacagaacctagtgttgaatataatttttgtgccatgcttgaatgtattttgacggattagcaaaataaaagtgaacctcctatttttcatcttaatgtgaagatcttt

SEQ ID NO: 74983 - DNA, 2824 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttttaaacagacagatgaccacaaacaacaacaaagagggg

SEQ ID NO: 74984 - DNA, 1639 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctag

SEQ ID NO: 74985 - DNA, 1438 bp, Homo sapiens
ggcacgaggcccagatagtggagcggaggtggcggcggcggcggtagcggtggccttggttgtcttccagtctcctcggctcgccctttagccggcaccgctccccttccctcccccttcctctcttccttccttccctccccttccctttttcccttccccgtcggtgagcggcgggggtggctccagcaacggctgggcccaagctgtgtagaggccttaaccaacgataacggcggcgacggcgaaacctcggagctcgcagggcgggggcaaggcccgggccttggagatggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctag

SEQ ID NO: 74986 - DNA, 583 bp, Homo sapiens
tcaatttgtaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggaggtaagagtgtttcatacaaaac

SEQ ID NO: 74987 - DNA, 884 bp, Homo sapiens
agcggaaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacagatgaagtgtttataagtcatcccaaggaagaaacaattcagatgagaactattcaatggatttgcaataacaatccaaagatggaagaagacacttctaggtagacaaaattgcaagtatagagaatgtaaattaagagagagcttagctttcagatgaattaaaagattgtggtgatcagaatgtagagattgacgagagacaaatgaaataaaactagaaggacaagtagagatttgtgggtcaagttttaaaattttattataaatgcactgatactgttctgaacattttcttacacatggaaatttaatgattatggctattgaaaaatgtaactcttcatttatatttttccgagaatgaaatcggtggaattgctggggggtgaaaatgtccaatgcgaaacaggaggctaatttaagaagggatactgcaaaattggtcatgatggctcaaactgctgttcataatagagagaagaaaatggatagagttacatatggatgagagtaaattgacaaggctaaatgctaaaacgtgggtagtgacagaaagtaggtgtcaaaatagacttccaggaaa

SEQ ID NO: 74988 - DNA, 808 bp, Homo sapiens
agcggaaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagaggatccatctctgatgttcagtgaagaggaccgggaaaaagcctgctagaagcaagtacca

SEQ ID NO: 74989 - DNA, 490 bp, Homo sapiens
atgttagcaccatctaagttctgtaggtctggaacacagactggttaaatgagcatttcaggagcgctatagttgcaaagttaagcagtcaccacaattttatgtgtcatacaaagatttttaactttatgtttaagcaacgagcctagaagcaaatggtatttccatcaagaattgtctcatataaagtagagcgttttggaaaatggagttattaatagataaaaacatgtttatacagttggtttctaagtatgacaaacctatttcttggtaaattgcaagtccattccacctgtgtttgtaggctcatttgcctaaaagtcttgggatttttttctgatgatctattaaattttctttctgattatcttttctaatgctgtaatagcatttctaacactgtaatgatgagcaagcgtgtacttcggtgctctatcattacagtgtcagaaatgctattacagccattagaaaggatgggtaccga

SEQ ID NO: 74990 - DNA, 1409 bp, Homo sapiens
acgcgtccggggtcaagcaatcctcccacctcagcctctcaggtagctggaactacaggcacatgccccatgcccagctaacttttgtattttctgtagacacagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtgctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgccgaggcaggaagaattgcttgaacctgggaggcagagtctgcagtgagccgagatcatgccactgcactccagcctgggtgacagagccactccgtctc

SEQ ID NO: 74991 - DNA, 1371 bp, Homo sapiens
acgcgtccggggtcaagcaatcctcccacctcagcctctcaggtagctggaactacaggcacatgccccatgcccagctaacttttgtattttctgtagacacagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagggtaagcggtgttgaactttctgcttgtgtattctctctgggcagagatgccacttgcctcccccaccatgccatctctgaagaatattacagaccattttggagcatggtgaataagaaattttcaccttaggagttcacttgaatagtcatttttatatttgtgactgcaagtcactcttaggggctgtacttccttagtactggtagcattattatccaatggacttttatagctttcattaggttttctttttttttttgagacagagtctcgctctgtctgtcacccaggctggagtgcagtggcacaatctcggctctctacaagctccgcctcctgggttcacgccgttctcctgcgtcagcctcctcagtagctgggactaaggcgcccgccactgcgcccggctaattttttgtattttcagtagagacggggttttaccatgttagccaggatgatctcgatctcctgacctca

SEQ ID NO: 74992 - DNA, 1330 bp, Homo sapiens
acgcgtccggggtcaagcaatcctcccacctcagcctctcaggtagctggaactacaggcacatgccccatgcccagctaacttttgtattttctgtagacacagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagggtaagcggtgttgaactttctgcttgtgtattctctctgggcagagatgccacttgcctcccccaccatgccatctctgaagaatattacagaccattttggagcatggtgaataagaaattttcaccttaggagttcacttgaatagtcatttttatatttgtgactgcaagtcactcttaggggctgtacttccttagtactggtagcattattatccaatggacttttatagctttcattaggttttcttttgtttttgttctttaaagaacgttttacttatcttagtatttcatttttcatctatattatgaggcagtaagagtcttctgtttttccaaaaggctgggattacagggcatgaacccacccgcgccttgggccttttcattatggaaatttttgagagggaaacaacaaattcactgcccagttcctg

SEQ ID NO: 74993 - DNA, 1002 bp, Homo sapiens
acgcgtccggggtcaagcaatcctcccacctcagcctctcaggtagctggaactacaggcacatgccccatgcccagctaacttttgtattttctgtagacacagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagattgtatatattcctaccagatggagataattacagctttaaaaatttttattttttcattttatttcacacattgacattaaatttttatggacacataataactgtacatata

SEQ ID NO: 74994 - DNA, 1184 bp, Homo sapiens
cacctcctgctacgcggcacccggtcacgtcaaccgcccaacggctgaggagtgcggcagcgcgccagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacagatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtgctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgccgaggcaggaagaattgcttgaacctgggaggcagagtctgcagtgagccgagatcatgccactgcactccagcctgggtgacagagccactccgtctc

SEQ ID NO: 74995 - DNA, 1630 bp, Homo sapiens
acgcgtccggggtcaagcaatcctcccacctcagcctctcaggtagctggaactacaggcacatgccccatgcccagctaacttttgtattttctgtagacacagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagattttctccatccccttattttgggccagtggctgtcattacatatgagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaatgaagaaactgaagctgagagaggtttagtgaatgactgaaaaggttgtcaggctgcagggaaaaaaacaaaacaaaactgtacgactagcctgcaatgcttcccaaagatgaagtgtttataagtcatcccaaggaagaaacaattcagatgagaactattcaatggatttgcaataacaatccaaagatggaagaagacacttctagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagggtaagcggtgttgaactttctgcttgtgtattctctctgggcagagatgccacttgcctcccccaccatgccatctctgaagaatattacagaccattttggagcatggtgaataagaaattttcaccttaggagttcacttgaatagtcatttttatatttgtgactgcaagtcactcttaggggctgtacttccttagtactggtagcattattatccaatggacttttatagctttcattaggttttctttttttttttgagacagagtctcgctctgtctgtcacccaggctggagtgcagtggcacaatctcggctctctacaagctccgcctcctgggttcacgccgttctcctgcgtcagcctcctcagtagctgggactaaggcgcccgccactgcgcccggctaattttttgtattttcagtagagacggggttttaccatgttagccaggatgatctcgatctcctgacctca

SEQ ID NO: 74996 - DNA, 866 bp, Homo sapiens
tgagccatcgtgcctggcccccagttgtgttctggcaggggaagatgggacagagaggatgggagggtgtctgagcctttcccggactgacggaacctgtgtcttctctcttttgtggacaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagggtaagcggtgttgaactttctgcttgtgtattctctctgggcagagatgccacttgcctcccccaccatgccatctctgaagaatattacagaccattttggagcatggtgaataagaaattttcaccttaggagttcacttgaatagtcatttttatatttgtgactgcaagtcactcttaggggctgtacttccttagtactggtagcattattatccaatggacttttatagctttcattaggttttctttttttttttgagacagagtctcgctctgtctgtcacccaggctggagtgcagtggcacaatctcggctctctacaagctccgcctcctgggttcacgccgttctcctgcgtcagcctcctcagtagctgggactaaggcgcccgccactgcgcccggctaattttttgtattttcagtagagacggggttttaccatgttagccaggatgatctcgatctcctgacctca

SEQ ID NO: 74997 - DNA, 935 bp, Homo sapiens
acgcgtccggggtcaagcaatcctcccacctcagcctctcaggtagctggaactacaggcacatgccccatgcccagctaacttttgtattttctgtagacacagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagattttctccatccccttattttgggccagtggctgtcattacatatgagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaatgaagaaactgaagctgagagaggtttagtgaatgactgaaaaggttgtcaggctgcagggaaaaaaacaaaacaaaactgtacgactagcctgcaatgcttcccaaagatgaagtgtttataagtcatcccaaggaagaaacaattcagatgagaactattcaatggatttgcaataacaatccaaagatggaagaagacacttctagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccatgcccggcgttgacttcttaataataaccatactgactggtgtgagatggtatgccattgtggttttgatt

SEQ ID NO: 74998 - DNA, 321 bp, Homo sapiens
ttgggattctcaattcacaaacttttgtgcgtttcttaattatttcctttctttttcttgtagagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacagtaagtaataaaggtgacgttttgatctttatctgcttaattacttctgctatgattctattgattctaacattgaaggagcagtaaatttatatgtattat

SEQ ID NO: 74999 - DNA, 681 bp, Homo sapiens
aagagaacaaaagtacacgcttgctcatcatttactaattctaaaaatatatattgaatacatctatgtagcaggtactgtggtaggtgtggaagatagttgagacaggtaacaagcccaacattacggagcttagcatcaccacctagaagagtttttaaaaaacatagataagtgaatcatgattataaagacaaagagattcttgccatataattacatataagcaaatttaggatgtgatgaaagattttgatattggtcttctgatttggctgtaggatgaagtgtttataagtcatcccaaggaagaaacaattcagatgagaactattcaatggatttgcaataacaatccaaagatggaagaagacacttctaggtagacaaaattgcaagtatagagaatgtaaattaagagagagcttagctttcagatgaattaaaagattgtggtgatcagaatgtagagattgacgagagacaaatgaaataaaactagaaggacaagtagagatttgtgggtcaagttttaaaattttattataaatgcactgatactgttctgaacattttcttacacatggaaatttaatgattatggctattgaaaaatgtaactcttcatttatatttttccgagaatgaaatcggtggaattgctggggggtgaaaatgtcc

SEQ ID NO: 75000 - DNA, 1372 bp, Homo sapiens
cacctcctgctacgcggcacccggtcacgtcaaccgcccaacggctgaggagtgcggcagcgcgccagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccagggaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtgctcacgcctgtaataccagcactttgggaggctgaggcaggcggatcacttgaggtcaggagtttgaaactagcctggccaacgtggcaaaactccatctctattaaaaatacaaaaattagccaggcatagtggtgcatgcctgtagtcccagctacttgggatgccgaggcaggaagaattgcttgaacctgggaggcagagtctgcagtgagccgagatcatgccactgcactccagcctgggtgacagagccactccgtctc

SEQ ID NO: 75001 - DNA, 962 bp, Homo sapiens
cacctcctgctacgcggcacccggtcacgtcaaccgcccaacggctgaggagtgcggcagcgcgccagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacagatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtg

SEQ ID NO: 75002 - DNA, 1420 bp, Homo sapiens
acgcgtccggggtcaagcaatcctcccacctcagcctctcaggtagctggaactacaggcacatgccccatgcccagctaacttttgtattttctgtagacacagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagattttctccatccccttattttgggccagtggctgtcattacatatgagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccagatctccgtcaagtgcagtaaccagttcaagttggaagtgtgtcttttgaatgcagaaaacaaagtcgtggacaaccaggctgggacccagggccagctgaaggtgctgggtgccaacctctggtggccgtacctgatgcacgaacaccccgcctccctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagggtaagcggtgttgaactttctgcttgtgtattctctctgggcagagatgccacttgcctcccccaccatgccatctctgaagaatattacagaccattttggagcatggtgaataagaaattttcaccttaggagttcacttgaatagtcatttttatatttgtgactgcaagtcactcttaggggctgtacttccttagtactggtagcattattatccaatggacttttatagctttcattaggttttctttttttttttgagacagagtctcgctctgtctgtcacccaggctggagtgcagtggcacaatctcggctctctacaagctccgcctcctgggttcacgccgttctcctgcgtcagcctcctcagtagctgggactaaggcgcccgccactgcgcccggctaattttttgtattttcagtagagacggggttttaccatgttagccaggatgatctcgatctcctgacctca

SEQ ID NO: 75003 - DNA, 378 bp, Homo sapiens
gtttcactatgttgaccaggctggtcttgaactcctgacctcaggtgatccacccatctcagcctttcaaagtgctgcgactaaaggtatgagccaccgcacccggcctcataattgcttcttacaggctagatactgggctgggtatattggggttttggaaagaattaagatgctctaagcagcctaggcaacacggtgagaccctgtctctacaaaaattaaaaaatgaaaaagccaggcatgatggcatgtgcctgtagtcctagctactcaggaggctgaaacaggaggatcacgagcccaggaattctaggctgcagtgagctatgattgcgccactgtgctgcagcctaggtgacagtaagatctggtctc

SEQ ID NO: 75004 - DNA, 520 bp, Homo sapiens
caagcagaagtaatcaagcctactgtgtatataagatgaaaagaatcaaaggggaagctccacaaagcgacttctttggtcctggcagtgtctctgcatcacctgtgtccttccttttcccgtgccctgccctctgccccgcttctgctctactttcttgctatttgcctcctaaggcttcaaaatactgctaaacacatttctaaagccttctagacataggacagtttgtgtatgaatcattttatttaagaattagggcaatcttttttgttggaagtagaataaattgtgctccaatttcaggtgcttatgaaaaatacattgtaccacaacctgaatattatgttgtgtaaatccctccagccatctcatttggggcaacttttagataaggaatgaaattacttgtggtataatctataattatttttggcaaatgcatgagtttctcctgcttgaaatataaatgttttattaggtagccacagtatttggcccctgcatgggtgcttaattg

SEQ ID NO: 75005 - DNA, 2234 bp, Homo sapiens
ctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcacctataatgccagctactcgggaggctgaggcaggagaatcgcttgaacccgggaggcggaggttgcatgagccgagatggcgccactgctctccagcctggacgacagagcaagactccgtctctaaaaaaaaaaaaagagggaaataaacatttatttgtatattgttatgtagccattaaaattctgtttccaagtaattttaattacaggggtaaattcttatatatctaaataagaatatacacatacacatgttccaaaatatttattatgtacttaaggcatatatattatatatgtatgtgtgtgtatatatatatgtatttgtgtgtgtgaacactaatatttgcatatatatacacacaagaaataaaaacatgttaaaaatggctatatctgcattgtagaattatgagtgattcatgtttttctaacttccctatctgtattaagtgttctatagtttatatttgttactttttacatcaggaaatagtaaagttattatttaaaacttatgaacaaaaaagtaacaagcacatgcaagcacagagttctaccaaatgcaaaaaatttcaaatcaattattcaaatgagacattaacatcacttctgtggtagttttatatccataaagtctgattcttctcctttgaagagatgaagcttaatcttcctcatcctgaaaatgggctggacttagtgacttacgtctttttattttatttttaattgacaaataataattgtatgtatttatggggtacaatattatattattatatatgtatacattatggaattattaaatcaagctaattaacatatccataacctcttataatttctttgtggtgagaacatttaaaaatgtactcttttagcaattagggacttacttttaatacaggaaaatggaagagactgtgagactttgaagtaggtcataaaagtcaactgccatgtcctgagcagccctggaaagacctacatgatgaagaactgagaccttctatcaaatgccagcagggaattgaggcctcctgtcaacagccattttagaagtagatcttccagcctcagtcaagccttcagatgactgcagccctgtctaatagcttgaccgtaatttcatgagagaccttcagccagaaaacccaaggaaaccattctggattcctcatcctcagaaactgtatgagataagaagtgtttgttgtagtacgccgctaaatttggggcaatttgttacatagcaatgtatagctcatacaatttctgggaaaaaaatagtttattttagaatcatttttgcataatgcaagaatataaacttgtcacagaataatttatccttgttttaggtggtccaaatatttcattgtcagttatatattagctcaaattaaattttagataatatatattattattaatggtaaagaatgtgtcacatttatctttatagcttttctgtacctaatattgtgtcttgtgcgtaggatgtgctcaataaaaattgattgaataaataagtgaatgaaagaataaatgaatgagtgaaggaattatctgaaatatttttataaaattccccatatgtatgtattacttattacaagtctggtcccatagctgaaaaaatattaaacattatatatatata

SEQ ID NO: 75006 - DNA, 2286 bp, Homo sapiens
ctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcacctataatgccagctactcgggaggctgaggcaggagaatcgcttgaacccgggaggcggaggttgcatgagccgagatggcgccactgctctccagcctggacgacagagcaagactccgtctctaaaaaaaaaaaaagagggaaataaacatttatttgtatattgttatgtagccattaaaattctgtttccaagtaattttaattacaggggtaaattcttatatatctaaataagaatatacacatacacatgttccaaaatatttattatgtacttaaggcatatatattatatatgtatgtgtgtgtatatatatatgtatttgtgtgtgtgaacactaatatttgcatatatatacacacaagaaataaaaacatgttaaaaatggctatatctgcattgtagaattatgagtgattcatgtttttctaacttccctatctgtattaagtgttctatagtttatatttgttactttttacatcaggaaatagtaaagttattatttaaaacttatgaacaaaaaagtaacaagcacatgcaagcacagagttctaccaaatgcaaaaaatttcaaatcaattattcaaatgagacattaacatcacttctgtggtagttttatatccataaagtctgattcttctcctttgaagagatgaagcttaatcttcctcatcctgaaaatgggctggacttagtgacttacgtctttttattttatttttaattgacaaataataattgtatgtatttatggggtacaatattatattattatatatgtatacattatggaattattaaatcaagctaattaacatatccataacctcttataatttctttgtggtgagaacatttaaaaatgtactcttttagcaattagggacttacttttaatacaggaaaatggaagagactgtgagactttgaagtaggtcataaaagtcactgtggcttcctccttgctctctcttggatcacttgctctgggggaaggtcaactgccatgtcctgagcagccctggaaagacctacatgatgaagaactgagaccttctatcaaatgccagcagggaattgaggcctcctgtcaacagccattttagaagtagatcttccagcctcagtcaagccttcagatgactgcagccctgtctaatagcttgaccgtaatttcatgagagaccttcagccagaaaacccaaggaaaccattctggattcctcatcctcagaaactgtatgagataagaagtgtttgttgtagtacgccgctaaatttggggcaatttgttacatagcaatgtatagctcatacaatttctgggaaaaaaatagtttattttagaatcatttttgcataatgcaagaatataaacttgtcacagaataatttatccttgttttaggtggtccaaatatttcattgtcagttatatattagctcaaattaaattttagataatatatattattattaatggtaaagaatgtgtcacatttatctttatagcttttctgtacctaatattgtgtcttgtgcgtaggatgtgctcaataaaaattgattgaataaataagtgaatgaaagaataaatgaatgagtgaaggaattatctgaaatatttttataaaattccccatatgtatgtattacttattacaagtctggtcccatagctgaaaaaatattaaacattatatatatata

SEQ ID NO: 75007 - DNA, 239 bp, Homo sapiens
gccccaggcatgggagttggcatatcatcctagttaagaatttctgagttaagaaatcttatatttgagtttagtgataagtttttctgacccagaaaacaaaacaataccaataataccttacgcttctcctattataacacttgttatgacattgaatttagttttctcattcttttgctaattgtgtaaactaggtgagaacaggaacctctgtttctctagttcattgtagtgcc

SEQ ID NO: 75008 - DNA, 698 bp, Homo sapiens
acctctggactctggaagcgtctcgcctcttcagcccttacacccgctagggagccaggctgttagcagaactcgtcatcctggatgcctgctgaaaggctagaattgaaaaggagacctgctgctttctggaccttcctgcctccctcacgctctccttgccctactctccaggacagcctgtgccagtacttcgcccaactcaggcacatgccccctggctgctcctgcaggccaaggaccggcatgcgctgcagcgccctctactgggcacctggccctcgctggttttctgatcctaaccagcttctcctcttagaatttcctgctgatccatcccagaatgaatgggagttcaatctgtactgaattatctttcatctagcaattgtgcaattccaaatgcaggtgaggttgagggaaagcgggcatcccctcacatccatgggatctatgtgtgggttgtatcaagagtctcaaaaatgctcatattctccggtcctagaattgggtctagcctaaggaaataattcagaactccatgtttttttaaagctttatgcacaaacatgatcataagacatgatttatgataaaaattggatgaagtaaactttcctatgaaagcagctgagtaggttaaattaaggtatacacttgatagccccttcataaagaattttcaagtgaaaaaaaaa

SEQ ID NO: 75009 - DNA, 392 bp, Homo sapiens
  misc_feature (8)..(8): n is a, c, g, or t
  misc_feature (18)..(18): n is a, c, g, or t
tgccctanaaccctagcnattttgggaagcctaggcaggaggatcacttggtgcccaggagttcgataccagcctgggcaacttagtgagaccgccatctccacaaaatgcccagccccagtggcttatgcctataatcctagcattttgggaagcctaggcaggaggatcacttggtgccaggagttcgataccagcctgggcaacttagtgagaccgccatctccacaaaaaagaaaaaaatcagccgagtgtggcggtgtgtgcctgtagtctaggtacaccagaggctgaggcaggaagatcacttgagcccagaggaggttgaggctacagtgagctgtgattgctccagtgctggatgacagagcaagaaagaccctgtctcaaaa

SEQ ID NO: 75010 - DNA, 365 bp, Homo sapiens
attttatatgctgtatgtattacatactgtattcttaagttataaaaaggaaaatgttactaggagagtcacaataaaagaggcccagccccagtggcttatgcctataatcctagcattttgggaagcctaggcaggaggatcacttggtgccaggagttcgataccagcctgggcaacttagtgagaccgccatctccacaaaaaagaaaaaaatcagccgagtgtggcggtgtgtgcctgtagtctaggtacaccagaggctgaggcaggaagatcacttgagcccagaggaggttgaggctacagtgagctgtgattgctccagtgctggatgacagagcaagaaagaccctgtctcaaaa

SEQ ID NO: 75011 - DNA, 678 bp, Homo sapiens
gcaaagtcatattgcactgggcatgagtccagggaagccattggctggggccatcagtgcaatctgtctacctcaccaggattcaaaggactcctgtttgactctaaaacccatactcttgtttccatactgtactaactataaacactcacacagccaaccttggtcactctcacacacttccccagtgcctattcgctgctctagtcagactcaccatgaggtgaacaaaacataattgtttccaactccaagcctttgacctattaaagaatcaatttttgtattgggtttgggaattaaattttctattgaaaataactttaaaaactgataaaccttgtaagaagaaagatctaaagagatttttcctccctaagttagcaacagaattcacatcacttatatactgcttcagttcattataacgagatcagtggtcatggtcaaaatgttcattatctcaaggtcagtgagaaaatttgacctgtgacaaacatagtttataacttcaagtaaagaagcacagttttatccgagaaacatgctaatgacagatgcagtgttctatagcaaacaattgtaatgtttggaaaagtttacagtccttgggtgataactataaacataaacccaattttgaaggaaaactcttgtctccaaagtaaagcaaaacaa

SEQ ID NO: 75012 - DNA, 721 bp, Homo sapiens
ggactacagctccatgactgctcgtgcagagcagggcttctccccaggcagagaatagcagctcagggcagttctgcaccatatttatacctacttttaattgcatgcagattaagggctggtttatgcagaaatttctagggaaagggtggttatttccgggtcatcaggtctttgccatggaaaagggcagtggctcctgagtgttgccatggtgatggcaaactgacatggcacactggtgggcgtgtccaatggaaagatgcttccgctctgtccctgttttggctagtcctcaatttggtcctgtgtctgagccctacctccagagtcaagatctgtttcttacctccagagggtgagggaagccccttcagaggccacctcacccctccacccaaccacactgtctataaactgggcctggcccccagctctgcaagaaggtgagttaagttggggcggcctcagggctcttggaggagcaaccctgatcctgctccatgctcctgtccaggtctggggtcagtgacatatcagagaccccagggagacccatataccctgatgacaagtcccaggtacaacacagagacccaaaccactgctgaatcaccctgtgacccttgtaggtattaagctcttgccctgtgtattatgtctgttctcactctgccaataaagatatacccgagactgggtaatttggtaatttataaag

SEQ ID NO: 75013 - DNA, 1087 bp, Homo sapiens
tcaaatccattgacataaagaccattcagttttacagtggaccatgtattgaaagtattttgtaacctctttcttacatttcttgttatgtaaccttttttctttcttttgttctcacttcaagaactaagccctcagggattctgtttggtaatcattagtactttaatcccttaagcctctggagaaatgaattactgtcttctagggtgctcagtcattcatactcagaaaattcttcttttttatgtacagtttgtgtgagatgctatgttgggtgtctgtatattctgcttgggcatcagatgaaaacttttctaggccttcagtcatatagctgtttttgttcacttgctgtcttagctctgtcttctgacaataattgattagctttttctcattctttcactaccctcttttagaacctttttcctacctactctctatcatatgtttttctcttctgtcatctgagttctaatttctcagctggctgtttcctttcttctgtctttgatcttaaaaagttttaaagttaaactctttgtaattttggatcattcagtacagccagaatttttctaaatattctttttactattagtaattgttcacactgtgtcagcacctctggccttgttagtataattatcataaaaaataaaggccttacaataataactaacatcttttatgcttctgccttttgtttgggttgccctgcacttcaaaatcacataggaagaaagagaatatcttggctatgttgtttaacaggaaaatgtttggggattggggtctattcttcagtttgtctggagaagacagcaaaccatagtgtgtttttacactttctgaaaactttttccagaacccagatattcatatgttacaattaatcaattaaatccatgtatgtggagtcactgtgtgatactaacttgaaaatatagaataggttggccgggtgcagtggttcaggcctgtaatcccaacactttgggaggccaaggtgagtggatgatttgaggtcaggagttcgagaccagcctgaccaacatggtgaaaccccatctctactaaaact

SEQ ID NO: 75014 - DNA, 636 bp, Homo sapiens
ggattccatgaaataaaattcatgtgtcacagcaggagtgaacatattcaagtatctcagtgcatataaccaaataactttccagaaaagctacaccagttacacttaacacccgcagtgtatgagcatgcccgtgtgatgggcacttcaacagcatggagtacccctgttgtgtttgctggccaggcgtggtggctcacgtctgtaattccagcactttgggaggccaaggcgggcggatcacctgaggtcagaagttcgagaccagcctgaccaacatgatgagaccctgtctctactgaaattacaaaaattagctgggcatggtggtaggctcctgcaatcctagctactcgggaggctgaggcaggagaaccgcttgaacccgggaggcggaagttgcagtgtgagatcacaccattccactccagcttgggtgacagagtgagactctgtctcaaaaataaaaaataaaaataaaagatgctaatttaccaagtgaaaaataatcaggaagtttttcttgaatgaataataaatagagataggactatgaattaagtagcattctgtcattgttttattagtaatataactattacaaatgtgatcaaatttttttttattaaaagtcac

SEQ ID NO: 75015 - DNA, 439 bp, Homo sapiens
ctttatctcaggaatccctgtcctgtgctgtttgctgtccagtgtccaagaactgttgtttcatatattttgtctggttttatttaaggaaggaggataaatgtggcctctgtaattccctgtgacctgaagcagctgataagtcccatattttataacaaaagactgacttcttagatgtcctttctcatataatttatactctctatatataacaattgaattgtaactcataaaattatagcagtgtcagatgtgtccatcaattaagttccataatacataagaataaaatggaaagtacattgtgaacttcgatagacatgttcacagaataacttgttattacttggtttaaaagtgcaatcctagttcatttgtttatatattttctaaaaagtttttatagatctcctgaattaaaatacttgtgatgata

SEQ ID NO: 75016 - DNA, 478 bp, Homo sapiens
gagctggtgagtggcctcatgtcttaccatcatggaaaggcgagggctgggggagagagaaggggcagccaaggcctcagagtggtgtaggcctcacccttgtgctcacatgtcccaaccactgccagcggtgccacctctgaatcccagaccccacatgtaaccatcctctacctggaccacaggaggaagctccacgttctttgccagggttcagggtaaggggcatgatctaagttgggcaaaagagagtcatcctgttaccttaaaaaggagtctagggtgagccccagtctgctggtggccatcttcaccacctttggggagagatggcctgagcagacacacaaagcaaagaggtggagagaaactgtgtctttgtgtcattgtttgagtccctggacccagcccagtccccccgactacgctgaacttttcaattgtggaaaacaataaattccatttagttaagaaaatt

SEQ ID NO: 75017 - DNA, 749 bp, Homo sapiens
gcagtccgtgtgtgtctgtgttgttgttcggcggcggcggcggcggtaagatggctgcccacgggggctccgcggcgtcctcggcgctgaaggggttaattcaacagttcaccaccattaccgacagagtcttgctctgtcacccaggctagagtacaatggtgcgatctcagctcactgcaacctccgcctcccgggttcaagcagttctccttgcctcagcctcccgagtagctgggattacaggcgcccaccaccacgcccagctaacttttgtatttttagtggagatgggggttcatcttgttggcgaggctggtctcaaactcttgacctcaggtgatccacccacctcagcctcccaaagcgctgggattacaggcttgagccaccatgcctggctgaagtttcagaaatttaagggaggtaattttgagttgcgaatggaatcttactagtagattcatttattggtagactgctacgtgccaggcatggttcacatcttaaggatacaactgtgagcaaggcgtggtgtctgtcctcagaaagcttaaaggttaacaggaatagagacacacgaataggtattagaatacagtgagagaatggtaaggagctaatactggagcacaaaagagggaggtcaagaaaaccttcccagaataaatacttttttatctaaaatctggaagatgtttcttgcaggagaaacatgcagagacttggaggggaattgggcagacatg

SEQ ID NO: 75018 - DNA, 6435 bp, Homo sapiens
  misc_feature (3645)..(3645): n is a, c, g, or t
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75019 - DNA, 6820 bp, Homo sapiens
  misc_feature (3645)..(3645): n is a, c, g, or t
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtagagacagggtttcaccatgttggccaggatggtctcgatctcttgatctcgtgttccgcccacctcggcctcctaaagtgctgggattacaggcatgagccactgcgcccgatctacaattctgttttctgtgtcccatccataccagattattgaaccctctgtgtgtatgtttttaaatcttgtatataattctacttccttgacttacaagtcaacaattagctattgagttctttatagaagttggaagcagggagatggaatggaaattccagcaaggccgggcgcggtggctcatgcctgtaatcccaatattttgggaggccgaggtgggtggatcacctgaggttgggagttcgagatcagcctggccaacatggtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75020 - DNA, 6173 bp, Homo sapiens
  misc_feature (3645)..(3645): n is a, c, g, or t
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtcgacgcggccgcgaatttagtagtagtaggggccgc

SEQ ID NO: 75021 - DNA, 6225 bp, Homo sapiens
  misc_feature (3435)..(3435): n is a, c, g, or t
ttcttgtgtatccccccgctgtacagttcatgcaagttcctactgtcagaccatacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75022 - DNA, 3377 bp, Homo sapiens
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttca

SEQ ID NO: 75023 - DNA, 5281 bp, Homo sapiens
  misc_feature (2491)..(2491): n is a, c, g, or t
accacttaatggaacacacaattcctgctgctagtactaggagaggtctgatccttacacttcagtttggtcaccagattaggtaagaaagaaaagtgtggggggagggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75024 - DNA, 5084 bp, Homo sapiens
  misc_feature (2294)..(2294): n is a, c, g, or t
ccggtccgtacatttgggtatcctttaactgcacgtgcttcacaaagctagcagtttagctgctctggaagagtgatctgttccctttttccatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75025 - DNA, 4751 bp, Homo sapiens
  misc_feature (1961)..(1961): n is a, c, g, or t
tcgccatagctgactctagaggatacacttcctctcctcccacctccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75026 - DNA, 5413 bp, Homo sapiens
  misc_feature (2623)..(2623): n is a, c, g, or t
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcaggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75027 - DNA, 4348 bp, Homo sapiens
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75028 - DNA, 2368 bp, Homo sapiens
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatatgctccatatttaacactcattctgccgtcgacg

SEQ ID NO: 75029 - DNA, 3570 bp, Homo sapiens
  misc_feature (780)..(780): n is a, c, g, or t
ttctggtggcaaaactagaatcacgactacccccccttcagaggactccatttaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcngggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaaaaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75030 - DNA, 1414 bp, Homo sapiens
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgagcacgtgcagtctaaagacacgatgttacaggtagcacgagctcga

SEQ ID NO: 75031 - DNA, 985 bp, Homo sapiens
gcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacatcaaataaactgactttttccccccaaaaa

SEQ ID NO: 75032 - DNA, 1797 bp, Homo sapiens
ctcaacgctttatacttctccagctattaacaaacttagttctcacaaatctaagcccagatgccctttagtctcccatcccatcaagttgagcctgaacaatctcatgatgctacaaacttaagatcagacaaacttctacactcccttctctcactcgaccctagacaatctattttttatttatttttgagatggagtctcgctctgtcacccaggctggagtgcagtggcatgatctcagcttactgcaaccttcacctctcaggttcaaacgattctcctgcctcagcctcccaagtagctgggactacaggcttcgccaccacgcccggctaatttttgcatttttagtagagacagggtttcaccatgttggccaggatggtctcgatctcttgatctcgtgttccgcccacctcggcctcctaaagtgctgggattacaggcatgagccactgcgcccgatctacaattctgttttctgtgtcccatccataccagattattgaaccctctgtgtgtatgtttttaaatcttgtatataattctacttccttgacttacaagtcaacaattagctattgagttctttatagaagttggaagcagggagatggaatggaaattccagcaaggccgggcgcggtggctcatgcctgtaatcccaatattttgggaggccgaggtgggtggatcacctgaggttgggagttcgagatcagcctggccaacatggtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagt

SEQ ID NO: 75033 - DNA, 273 bp, Homo sapiens
actacatggaagttaaaaatattcttctaaataattactagatcaataaagaaattaaagtaaaattacatactatttaaggtatttggaaaatagtggaaaaaaaacattttgtacaaaaacctgtgggatgtaattacagctatattatgcaaaaatatatctttattgcttttgtaatttaaaaataactataagtaggtgaacttcaaattaagaaatcagaaaaacaatgggaaccaatataaatgagaaaagatgtaaattatcaaa

SEQ ID NO: 75034 - DNA, 862 bp, Homo sapiens
gttgattcctagaggtggaatccattaaactgacaaagccccagtcccggggtcctaatagtcgggactattaggtcatcctgggtactcaggcctctagactctagactgagctgccttggtcactcggggacagttggcagagtattcgtggtcagggaggtgacccgtggtcagcaggatcaggccacccagggacaaagggtgcttctgcgccaggccctggagaaggacagagcggtggggactcggggtcggccgcagataggggagtcaccacctgccggcaatcagccatgactgcctttgcactgtccatgctctcagcccaccacctcctccccctgccattgcagtggctaacactggagacgaagaccaagacaccaccgcctttctccagtacctctcaaatcagcacaggcaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctgtaggatgcacagcttcccatcagcccacctgaactccagccatgccattttaataccaggaataaggtcacctgctttcctgccccttaggaggccagagccgtggaagcaaaatggcacttctgtttacctgttatattatttttttgtcatccttatatgcttggaaaatgcaattatatgaaaaaagtttagtaattacagacataacagcagaaag

SEQ ID NO: 75035 - DNA, 798 bp, Homo sapiens
cagcaaacttcaaactttttaatggaacaaggacacacagacattaatccccagtgtccatcaaagttgcaatgcagccctaacgcctggcatccttgaaagggacgggcatttagtaatgagatatgcacagcagcatagtcagctgtgtggtgcattctcagctgtgcctcagcagccctgatgcagacatccagaaggagcacagccactttatccagagcaatcagccatgactgcctttgcactgtccatgctctcagcccaccacctcctccccctgccattgcagtggctaacactggagacgaagaccaagacaccaccgcctttctccagtacctctcaaatcagcacaggcaaggacaaaggcctcaatccacaactgctgaagatggaccctggccacatgggatggtcagacacgcctgcccagctatctgcaggcgaagaggctcagaagaggtttaggggcctgaaggacatcttgcttccatgtccatatgagcaggctatttctgctccatgagtcaattttgccatataaaatacttaatttcagccattccagggtgctgtaggatgcacagcttcccatcagcccacctgaactccagccatgccattttaataccaggaataaggtcacctgctttcctgccccttaggaggccagagccgtggaagcaaaatggcacttctgtttacctgttatattatttttttgtcatccttatatgcttggaaaatgcaattatatgaaaaaagtttagtaattacagacataacagcagaaag

SEQ ID NO: 75036 - DNA, 456 bp, Homo sapiens
ggaggttgtgagcagaagcttaatgaagaaaccacattggcttacagttactgtctgcaatccacccccattcctcacaatttaagctcctaagtttgagatggggctaaggttcttaaaggtagtatcaccatatattcaagtcctttctctttatttctgaggtttttgggatccaagcagccctggtatgtttttagaacacagtacacattgtgtaacagtcactgagcccaactcttacatagggcctggcagtgttgcccttgtgtatcccttccccttgagtatggggtcggacctagtgactggcttctagtgaacagaatacagtaaatataatgggatgtgtcttccaagattagggtataaagcactgaattctaccttgcatgagcattacattttataatatatataaagaagcaactagtatagttatttaaacaaatattt

SEQ ID NO: 75037 - DNA, 661 bp, Homo sapiens
taggaaaacaggttttagctttacctgttgaggcaaatatttgagctgtacattgtagattaatgaatgctactggagaagtaaagaagtctggagggagggaaccaccacccattgtcctaacaatgcacatttctattgctttcttgtcttgaaggcatatatatcacccaaatggactaggttcccacaaaatttctactttaggctaggcactgcactagctcccacttctctaagctgttatatctgtggaatttgatgggacacccagtacacaaagtaataaaaatcataatgtataacaagtctctttacaattaccttactgcgtcttgtttcagtttcatatatataataaacaggcagctctgcttcagagatgttacgtatcagcaactaacctactaataaatgcaatttggcaatatgtaaatagccttaaaatgtgtgaagaaaaccagaacgtatcactccaaaatatgcctttttgacatagaaattattttggagaagccaggcacggtggctcatgcctgtaatcccagctacttgggaggttgaggcactagaattgcctgaacctgggtggcggaggttgcagtgagttgagactgagccactgcactccagcctgggcgacaaagcgagactctgtctc

SEQ ID NO: 75038 - DNA, 452 bp, Homo sapiens
caaaagcgctctggctctcaatggagacatcaagccctccctgccccttctccctcccctttcagagaatctccaggaatttctgccattgtgcagggagcaattgaaaaatcagttagttcagctgggtgcagtggctcatgtctgtaatcccagcactttgggaggctgaggcgggcagatcacctgaggccaggagttggagaccggcctggccagcacagtgaagccccgtctctactaaaaatacaaaaaattagccgggcgtggtgatgggcacctgtaatcccagctactctggaggctgaggcaggggaatggcgtgaacctgggaggtggagcttgcagtgagccgagactgcagcattgcactccagcctgcgcaacaagagtgaaactgtctcaaaaaaacaaaacaaaacaaaacacaaaaagaaagaaaaaaggaaaaa

SEQ ID NO: 75039 - DNA, 318 bp, Homo sapiens
aaactcccatttttaaaaccaccagatctcgtgagacttattcactatcacaagaacagcatgggaaagactcgcccccatgattcagttatctcccactgggtccttcccacaacacgtaagaattatgggagctacacaatgagatttgggtagggacacagagccaaaccatatcaactttccctgcacaagctctctgtctgctgccatccatgtaagacgtgacttgctcttccttgccttccatcctgattgtgaggtctcttcagctacctggaactgtaaatccattaaacctctttcttttgtaaattg

SEQ ID NO: 75040 - DNA, 2097 bp, Homo sapiens
aaagaataattctgtatataaacagtggaggtagataaatctatcttcttttatagtcctatctctcctatttataaaaatctacaaaaaccaggtattttctcattattttaatggaattatttcctaacaaacttgatggtattggataaaattaaagtttattctaaactgttaagttgtaggtccttggaaaatttgctttgttaactcttttgtcatgtggagagagagagagatggaggggagagaattagttagctagggttcttaagaatacctttaatcattacataccctgtatttttaaatagctatgttttgcccctcaaaaagtattcaaaataaatactaacagaaattcaatattgtaatatattttagtaatttttttgtatcttaatgttaggtcttcaaacatgaactagcttacttattggctggaattcttggagcagcaatagattattggattttccttggtcttaagatgggtagaaatgtgatgcgacacatgtctgatgacttaggaagttatgtttctctttcgtgtgatgacttttcttcacaggaattagagattttcatttgctccttttcctcctcctggcttcaaatgtttgttgcagaggcagtctttaaaaagttgtgtctacagagctctggcagtgtttcttctgagccactctctcttcagaaaatggtatattcctatttaccagccttggggaaaactggtgtgcttgggtctggaaagattcaggtgtcaaagaaaataggacagcggccttgttttgactctcagagaaccttactaatgctgaatggtactaaacaaaaacaagtcgaagggctgccagagttactagacctgaaccttgctaaatgttcctcatcattaaaaaaattgaaaaagaagtcagaaggagaattgtcatgttccaaggagaattgcccctctgtagttaaaaagatgaattttcacaagactaatctaaaaggagaaacagccctgcatagagcttgcataaataaccaagtggagaaattgattcttcttctctctttgccaggaatagacatcaatgttaaagacaatgctggctggacgcctttgcatgaagcctgtaactatggcaacacagtgtgtgtccaggaaattttgcaacgttgtccagaggtagatctgctcactcaagtggacggggtgactcctttgcatgatgcactgtcaaacggacatgtagaaattggcaagctgctactacagcatgggggcccagtgcttttacaacagaggaatgctaagggagaattgcccttggattatgtggtttcacctcaaatcaaagaagaactgtttgctattacaaaaatagaagatacagtggagaactttcatgcacaagcagagaaacattttcattaccagcaacttgaatttggctcctttttacttagtaggatgttgctaaatttttgttcaatttttgatttatcttcagagttcattttagcttccaaagggttaactcatctaaatgaactgcttatggcttgtaaaagtcataaagaaaccaccagtgttcatactgactggttactggatctttatgctggaaatataaagacattgcagaaactcccacacattcttaaggaactgcctgagaatttgaaagtgtgtcctggggtacacactgaggccttgatgataacattggaaatgatgtgtcggtcagtcatggagttttcatgatgatgctagaaagtatggattgactttctaaatctgttcagtttgcattggtacttactgtggacttcatagcttactgacagatagtaatttgatttatttattgacagactttgcagccttgctaaattttaaaagcatttttaaaaaaacttctacaaaactctagtatgggcttctgactttttccagggtgtagaatttgactcaaaagtaaaaataattttgttttagtatattctactttcattaatgtttttttgttctgaaagtgatattatattgtacatgtaaaattaatttaaatattttttcaaataaaaatgtaatgtcctgta

SEQ ID NO: 75041 - DNA, 4067 bp, Homo sapiens
aaagaataattctgtatataaacagtggaggtagataaatctatcttcttttatagtcctatctctcctatttataaaaatctacaaaaaccaggtattttctcattattttaatggaattatttcctaacaaacttgatggtattggataaaattaaagtttattctaaactgttaagttgtaggtccttggaaaatttgctttgttaactcttttgtcatgtggagagagagagagatggaggggagagaattagttagctagggttcttaagaatacctttaatcattacataccctgtatttttaaatagctatgttttgcccctcaaaaagtattcaaaataaatactaacagaaattcaatattgtaatatattttagtaatttttttgtatcttaatgttaggtcttcaaacatgaactagcttacttattggctggaattcttggagcagcaatagattattggattttccttggtcttaagatgggtagaaatgtgatgcgacacatgtctgatgacttaggaagttatgtttctctttcgtgtgatgacttttcttcacaggaattagagattttcatttgctccttttcctcctcctggcttcaaatgtttgttgcagaggcagtctttaaaaagttgtgtctacagagctctggcagtgtttcttctgagccactctctcttcagaaaatggtatattcctatttaccagccttggggaaaactggtgtgcttgggtctggaaagattcaggtgtcaaagaaaataggacagcggccttgttttgactctcagagaaccttactaatgctgaatggtactaaacaaaaacaagtcgaagggctgccagagttactagacctgaaccttgctaaatgttcctcatcattaaaaaaattgaaaaagaagtcagaaggagaattgtcatgttccaaggagaattgcccctctgtagttaaaaagatgaattttcacaagactaatctaaaaggagaaacagccctgcatagagcttgcataaataaccaagtggagaaattgattcttcttctctctttgccaggaatagacatcaatgttaaagacaatgctggctggacgcctttgcatgaagcctgtaactatggcaacacagtgtgtgtccaggaaattttgcaacgttgtccagaggtagatctgctcactcaagtggacggggtgactcctttgcatgatgcactgtcaaacggacatgtagaaattggcaagctgctactacagcatgggggcccagtgcttttacaacagaggaatgctaagggagaattgcccttggattatgtggtttcacctcaaatcaaagaagaactgtttgctattacaaaaatagaagatacagtggagaactttcatgcacaagcagagaaacattttcattaccagcaacttgaatttggctcctttttacttagtaggatgttgctaaatttttgttcaatttttgatttatcttcagagttcattttagcttccaaagggttaactcatctaaatgaactgcttatggcttgtaaaagtcataaagaaaccaccagtgttcatactgactggttactggatctttatgctggaaatataaagacattgcagaaactcccacacattcttaaggaactgcctgagaatttgaaagtgtgtcctggggtacacactgaggccttgatgataacattggaaatgatgtgtcggtcagtcatggagttttcatgatgatgctagaaagtatggattgactttctaaatctgttcagtttgcattggtacttactgtggacttcatagcttactgacagatagtaatttgatttatttattgacagactttgcagccttgctaaattttaaaagcatttttaaaaaaacttctacaaaactctagtatgggcttctgactttttccagggtgtagaatttgactcaaaagtaaaaataattttgttttagtatattctactttcattaatgtttttttgttctgaaagtgatattatattgtacatgtaaaattaatttaaatattttttcaaataaaaatgtaatgtcctgtattctagatgttctaggtcttagaatcatggcaagcatattcatacaaatgcgtacctataaacttgtagctcctgactcttagggatggattttgaggaaaaaacaagactaaacaaaaacatgtagctccctatttcttctctctaggttgttggactgaaatatgcattttagctttgtgtgtttctaaaataaacatttctaaaattacagtaataattaatattcttttggtttttaaatgcagcaaatatgcagagtctgacagttcaattccttgatctgttttattttagcaattcatatacaaaatgtatctgtcgctgccctatgtaacccagtattctgtacctgaaaacattctgctgcataggtttatgagtttaatattaagatattgagtggcatctaagtaatagatttgagattatttaagatcttaatatatagtatgaatttactgagtagtaatgttttaatttgcagtttttccttatagcagtttgtagtaaaactaaaagaaagggtgtggataataaccacttttgagattggagtttcttcactactgggagtaagttacattatgatacaggtggaaaataaacacttccatttagcttttatgtaattcaagtgatgaccttagcagttaatctgctaaagcaatacacttcagttttattttggaaatagatattttaacaagatacaaatgctcagtatcatattactgggtttgtaatctaaattgaaaactgctacatcagtatgaaaaaatattttaaataagtactttttccacacatactcaggaaatactagtttctatttagccttcaaatttggcatcatacaaatctctttattattaatctgccaaagtatcagacaaaaaatgatatagtgaagactatctaagaagagtttaaatgcttatagagagtaaagtgcttctccagatgatgaataagaacgttttttattccaatgagtacctctttacttcacttgtaaaggtgtctgggatagtgtttgcttggtaaactaatataaacttgtaaacataggctttgacatcatacacattttcaaatccttgtctagtttcttaataactaaattgcaaggcaaattcttttctgagctttggctttcctacatgtcaaatagaaatcacaccaggtatctttgtcatgatagaattgttagcatatcacatcatatgacacttaataaatattatttcctttctaattcttacctcctcttttgattataatgaatcatttagacaaaaggcaatatagtaattgtttaagttggtagtaattctaaggtaattaaggaatcaacatcatgagttagggttttatactgttagtacaaagtagttttccaaattagatgttcataacgtatatttgtttaattgcaattagcattaatatttcataattgactgctctgtctgccaacttctacaagcagtgatgacatgaagtgtgaaacagatgtcactgaggtctctgcctttaagaagttttacacttcttcgaaagtccaacgtggcaaacataggttactgtgttctgtgccctggctaacaataccagtatatgagtatgaatttaaattttcaggaaaaggcttcattcccaaaattacttcttatactttattttagaaaacataataataattgccttgaataattgcccaaatctatcttggaggtataggaagaagaaattctcaataagtaaagtataattcatagtcttagtcctagattttcaatggcagacttttcaaagttgcatctgaagacaaggttgagaaatgctattcttcactgtattttgccagatgtgatatcatagttctatggaatcatattttttaaatttctgtaagagaccttattacaatgtaaataaagctggagaggagatttctgagcagttaa

SEQ ID NO: 75042 - DNA, 2058 bp, Homo sapiens
aaagaataattctgtatataaacagtggaggtagataaatctatcttcttttatagtcctatctctcctatttataaaaatctacaaaaaccaggtattttctcattattttaatggaattatttcctaacaaacttgatggtattggataaaattaaagtttattctaaactgttaagttgtaggtccttggaaaatttgctttgttaactcttttgtcatgtggagagagagagagatggaggggagagaattagttagctagggttcttaagaatacctttaatcattacataccctgtatttttaaatagctatgttttgcccctcaaaaagtattcaaaataaatactaacagaaattcaatattgtaatatattttagtaatttttttgtatcttaatgttaggtcttcaaacatgaactagcttacttattggctggaattcttggagcagcaatagattattggattttccttggtcttaagatgggtagaaatgtgatgcgacacatgtctgatgacttaggaagttatgtttctctttcgtgtgatgacttttcttcacaggaattagagattttcatttgctccttttcctcctcctggcttcaaatgtttgttgcagaggcagtctttaaaaagttgtgtctacagagctctggcagtgtttcttctgagccactctctcttcagaaaatggtatattcctatttaccagccttggggaaaactggtgtgcttgggtctggaaagattcaggtgtcaaagaaaataggacagcggccttgttttgactctcagagaaccttactaatgctgaatggtactaaacaaaaacaagtcgaagggctgccagagttactagacctgaaccttgctaaatgttcctcatcattaaaaaaattgaaaaagaagtcagaaggagaattgtcatgttccaaggagaattgcccctctgtagttaaaaagatgaattttcacaagactaatctaaaaggagaaacagccctgcatagagcttgcataaataaccaagtggagaaattgattcttcttctctctttgccaggaatagacatcaatgttaaagacaatgctggctggacgcctttgcatgaagcctgtaactatggcaacacagtgtgtgtccaggaaattttgcaacgttgtccagaggtagatctgctcactcaagtggacggggtgactcctttgcatgatgcactgtcaaacggacatgtagaaattggcaagctgctactacagcatgggggcccagtgcttttacaacagaggaatgctaagggagaattgcccttggattatgtggtttcacctcaaatcaaagaagaactgtttgctattacaaaaatagaagatacagtggagaactttcatgcacaagcagagaaacattttcattaccagcaacttgaatttggctcctttttacttagtaggatgttgctaaatttttgttcaatttttgatttatcttcagagttcattttagcttccaaagggttaactcatctaaatgaactgcttatggcttgtaaaagtcataaagaaaccaccagtgttcatactgactggttactggatctttatgctggaaatataaagacattgcagaaactcccacacattcttaaggaactgcctgagaatttgaaagtgtgtcctggggtacacactgaggccttgatgataacattggaaatgatgtgtcggtcagtcatggagttttcatgatgatgctagaaagtatggattgactttctaaatctgttcagtttgcattggtacttactgtggacttcatagcttactgacagatagtaatttgatttatttattgacagacttgagctgtaatttaaagcatttaaaatttacaatcagtttggttggtttcaggaaatggccaagtaatattgggtattattataggttgcaaggtttggcagagcaatttaaagttgttggaaaaaaaaaggtgggcgataatggggggagaatggagtaagggagaggattgataataaatataa

SEQ ID NO: 75043 - DNA, 664 bp, Homo sapiens
attggataaatattaccattccaaacaagagaaattagccaaaagaggctgcaggccccatccaagtctgaaatacagcagtgcagtctttttttaaatatcccaaataaccttctttgactccatgtcttaccttgtgcctcacaagagcacattggtataaggagtgggctcccaaagccttgggaagctctgcctctgtgactttgcagggtaaagggttggagtttagtgcttgcagcttttccaggcacagaggcaagctattggaggatcaaccattttggggtctggaagacagtggcccccttcccccagctctctgaggagcaccccagtgggaactctgttgggcctccaaccccacatttcccccccatactggcttagtagaggttctctgtgagggctccatctctgcagcaggcttctgcctggttactcaggctttctcatacatcctctgaaatctaggtggaggttgccaaacctccttcacccttgcactctccacacctgcaggcttaacaacacgtgttagccaccaaggcttatggcttgtgccctgcacaagtggcaccccatgccttacttgggccctttagagctgagcagtgtcccaaggctgggcagccccttctctatggctgcttttacatttttt

SEQ ID NO: 75044 - DNA, 625 bp, Homo sapiens
accccagaaagagctgccagtaggaggagggccagcctcactggtgattggagtccagcagtcccactgattgggagtgctgagccaagcccatgtcgtgcttcgctgatgcatggctgggctgaagaaagagctctttgaatttttcatagaaaagactggtgcccaaaaggccagggctcgagaatgaggctgcctcaagcacagtgcttggcaggacaccagggctgaaaggtacagcaaagtcctcccagaatcgcttgtcagagcagggatttgcatcacagactggccactgcaaagacagatgggaactcacaggttttgtgtgtgtgtttgtggttcactgctgatggacgcatgtcagaagccacctgagccttggcccagccttcatgtggagtgaaaacccagacctgtgtgagcagcaggtacttgaagcaagagaagcaaggccgagcctccagggctttgtcagaggctccttccttcctggaatccaattgtacaaccaggagccagaggtcttggtggccggatgtgggtctaatcctggttccatggcctcccaactgagtgaatgagattataatgataaaatataatttactgtgtacccggcact

SEQ ID NO: 75045 - DNA, 500 bp, Homo sapiens
tggctaattttttttgtagaaatgaggttttgccatgttggccaggctggtcttgaactcctggcctcaagtgatcctcccaccagggcctcccaaagtgtgagattacagatctgagccaccaccttcagcctagagctgtttttaatgttttagttgttgttttctctttggtattaaatatagtaaattgaacagtatgcactcaataagcaaagcctgaatgaatgatacagtggagatgaatattacaagctattgtaggaaaactgctttatgaggcttgaactattgcttgatgaatgtcaatataaatgaataagtggtaatgacaccaaatctcagatcttcgtatcataaaaatgcttgcaggttactgcctaatcacacaccattaacatttcctttccttacctttgcctgtgttgtattacatatagtaactggaattaatttttatagtgtattttttcaagataccgaaataagtcctctaccaa

SEQ ID NO: 75046 - DNA, 426 bp, Homo sapiens
tgtagactaggttaatgcaaccaggttaaagaaactagagggttgaagtacaataaagggtgtccagaattcttaaatgcagtaaaacaaacaaacatgtagcagaggggccttgtctagggtatggatgtttttcgatttaaacaaaaaggaggaaaaataaccaaatgatctagcaattccttagaacgtctgtatactatctatccaatgtaataattaatccaaatcatctgtcactatgcactgccactccattctgataacaaccctctaaccatgtctcaccaggaaataacatttttattcatacaagttgcaggttattttcaagacagacttcctctgtgctgttcatcatgcataccttagctaaagtattgtagctagaatatagcagcaattttccaaccgatcttcgagtct

SEQ ID NO: 75047 - DNA, 800 bp, Homo sapiens
tacacacacacacacacacacacacacacacacacaagatgactaaaagtgttgggatggtaggcctcttgagtatgttgtgcatgggaatttgctgtcatcactcatagcaacgtgtataaactcaaggatcccatccatggaggtatgctgccactgcctctatacaacctacaaaatatttccttacaaataggacaaagaaagtaagaagataaatgatgacttttatttgccaacatttggttcagcacaactttcctaccctgtctctccccacctttgcccttaggctaaggagcagaaaagtgatttgtcaagatggagcaaggtatttaccagtctaaaacctaatgctgtaaaactaaatgagacaacttggggcttgaatgggtgctgggctgtaggtactgctgggtcactgttgctataaatggtcactggagcagattaataaatcaaggatcagtttcacccacatttaaaggactacttgactcatttctgtctcgagtaaatggactttggtagtagcaacgccataccgtgatgatatcatttgtgttgggaatcaaactgggcaatgcaagagtgtttttgaagcctaaatctatgtaagacttatcagtttgggagaggataataataaaagtaacaatcaatgcttccaaactccaattgactgtcttttttagcttttatatttacctagttgttatgctaaccaattcagctttttactgttgctgttgttgttgttttaagaaataaaatttctgattgctgttttcataaagttc

SEQ ID NO: 75048 - DNA, 1301 bp, Homo sapiens
aacaggagggactcttaaataacaagcccttgattgcctaattagcctgaatgccctcactttcattggaattcactgctttgatggtgtggaggtgcaaagaggccagctatcaaagagagacgccacttatctaaacaaaatccaggaacagaattcgagacccttgtctctcagacgaagattgtttgcccagtataagagatttcatcctcgcttttgatagaattatgattcttgggaaatctttacgtggaaaaaactgcctcagaataaacaccaagtgtttcaaaataactacaggaagtccaagccacagcaaaatttaaatctctatttacaaaatgaaggtattcattcccttattcattcagtcaccaaacacttctttttaaaacatttttctttatgtctcatggattagaccctaggcattagtgaattaatgcaagagcatttatctctttgtaagtttccatttagctgtaatggaaaagaagtgtctaaactagatgcagctaatttgaaattcctgtctcctttttttcttctgattaaaaaaaaaatgcatttaccagtactgtcagaaaaaaaaaaaggaaaaaggaaaaaaacacctatttaaagagacgctgaaccttctccactaatcctccttatccctcaggattgccatcactgattggggttggctttgggtatggaaagaacatagaacttggagtcggaggacctgattgtatctcagcttaggcacctagcagatgtatgacctaggataagtcattaacctctctggtttttttagatgtgatcggggttggaaggcaggtagcaatatctaccttactgtatcattttgaagactaactaggataacaatgtgaagccttgtcagttggcaagtatcaatggaaacttagccaacataagctcactccttttggatatcccaatgtgtgaaaaggccctttagcacctgagaaatcagaatgcctgggacatacatgtttggtgaacgaatgaaggagagatggtgacagaatttactaagacccagatgtgttcttgttttctaactttatccaggaaaataaacagcaaaagatttagcaaatcttatcatttcttagtgggttataaccatgagctattaattttgacacaaaaaaaaacttacctcctccctttatttcagcttgtgaggatatgtcactaattgacttcattaatttgattcaaactgtgcactagaagtgggatagaaacacatgaagtataccggaaagaaattatactcg

SEQ ID NO: 75049 - DNA, 282 bp, Homo sapiens
ccctgacaagcaatctcatttcattctcacccagccttgtgagataagtgccattacccattttacagatgaggaaaacaaggctcagaaaaacattaagtgacttgcccaggggctgtgtagttgctgcactgggattcattcattcatgtgtttacttgttcagcaagaaattttgtgtggatgcaatgtgccaggcctcaggcaggggctgcctgatgctgttggttttttgtgttgtgttatattgtgctgtgtttttgagagacagagtctcactgt

SEQ ID NO: 75050 - DNA, 338 bp, Homo sapiens
cagagagctggtctcaaccccctctccagccacttgagatggtgggaactcagtggtggctgagtctaatacggaagaattgcagaatccactggtgaattgctcctttgttctcctaatcttctaatccaggggaacagagaaaggagttttcctgggacttggggcccagccttccaaatccttctgtctttgaccccaccctgggttgggatgagggagggcaggtgagaagacaccagggagagtgtggtgtcaaaattgtgaaaacctttagccatggccacccatcacctttctcaaggagctggatttacattgatctcctgttaggaccc

SEQ ID NO: 75051 - DNA, 541 bp, Homo sapiens
actgaggcatgaagggaaccatggccgggaggcagagctactccagagagaaggcagcggcggcctgagcccctgtaaatgttatatatgtactttttttactatgtggcatcgaagcctgtggacattttcccagtccagagcctctgtttcggacaggtgggagcgtgcacatggctagggcacagtcaggtgtctgtggtcctgatctaggaagcagagactccggctttatcaccacctcggtgtctgtgctttccccttaaactgcctccctcctcacctggactccctcaccatgcctcctttcctctcactcctctgccaccccggtacccacccctctctgtagactgcaagactcaacaagtgacgtgctgagcaaaccctgagagaagaggtctgtttagggacacaggaagccaagtacagaaaaagcaaaagaattagcatggctttttcaatggatgtctattttacaggactggctgtagattattgttatagctttaaataaaaggatagttttcgtctcggccca

SEQ ID NO: 75052 - DNA, 430 bp, Homo sapiens
tctcaaaaaaaaaaaaaaagaaagaaagaaaagaaaagattgtatctttaatagtaattagagtggtttgtgttattttgattgtgagtattttaatgacagggcatacagtcagccctccatatccacgggttctacatccacagatccatccaactgtggatcaaaaatatttgaaaaaatttacaataataaaaaacaaaataatacagtataacagctatttgcatagtattataagtaatctagagatgatttaaagtatacaagaggatacgtgtagcttatatgcaaatattatactgttttatataaggaacttgagcatctgcaaattttggtatccttgggatggggtggatcctggaaccaatcctctacaaatactgaggtttgttgactgagaaagtgatggcacaacagcatttca

SEQ ID NO: 75053 - DNA, 196 bp, Homo sapiens
tacacacatacgaacttcttaacagttttctaaatcaatcttgagacagtcacttgtgaaaattccctcttggattaattacacttttcattaggcctgagattataagggcacatatatgacagagcttgtcatggttttagttggtcaaagaatagaataatcaatcatctccattcttagagaatggcataat

SEQ ID NO: 75054 - DNA, 111 bp, Homo sapiens
ctaattgtgtgtgtgtgaacaaatgtatacttttggctgagaagtataagagggttatttatctataattttgtatttaaaatgtatgtactaaatatattacatataata

SEQ ID NO: 75055 - DNA, 648 bp, Homo sapiens
catgcattgacagattactccttaggcaaaagtatttaagaagggataagtagaaattctgattggaatattaaaacattttttaaaaattaattatgtttagactgttgaaccgtgtttatataattttaggataatggatttatttgcttttttttttttttaagagaaactacttgaagtaaattcctacccatacttcttacttgtctcctttcctttgattaatctaaggaatgttgatgatgagaagaaagatggaaatgttgaggtggttgcatatttggtttgttagaatatctgtcatcacctgggctatttgaagctgctgttgctgatgttgttttattgactcatgaagacaactgaaaagattgctttgtaaccttatttttttctgatgtgtgtttacatccatgtctatatatacatattgcatatgtatatatctgtatgtgcatgtatatgttaaaaatctgatataagtgaaaacatgctctgtgctttgagcaagtagagtcttttccccttctttgtctttctctgagttgggctctaattttgggggaactcttgggggaaaatgaatgaaaaacttgctaaggtcctttttgctttatatacaaatatgtacattttagaattcat

SEQ ID NO: 75056 - DNA, 455 bp, Homo sapiens
agtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggata

SEQ ID NO: 75057 - DNA, 448 bp, Homo sapiens
ttttttttttgagacggaatctctctgtcgcccaggctggagtgcagtggcacaatcttggctcactgcaacctccacctcccgggttcaagtgattctcctgcctcagcctccagagtagctgggattacaggcgcccaccaccacgcccagctaatttttgtgtttttaataaagatggggtttcaccatgttggccaggctggtctcaaactcctgacctcaggtgatctgcccacctcggcctcccaaagtgctggattacaggcaggagccaccgtgtccggccaaaacttcctaatttctaatatagtaaacattaatggataaatctgtataaacaatagcttcttgaggtcttacatctttaagagtgtaaacggggccaggtacagtggctcacgcctgtaatacccatgctttggcaggcagaggcaggaggactgct

SEQ ID NO: 75058 - DNA, 649 bp, Homo sapiens
tctttctttttttttaaatcttttgctgtctttgaccaagccaaaagagttacaaccaaattcaaaaagccacccaacccaagatcaaaactggatgagtcaaaaatgtgtgctgttcctccaagaactcattgacatgccagtctctgaccttcctaggatgaggccacagctcccagtagctcatgaacctagactggcattcagtattttaggagtttcattgcatcatctgtccatccatccatccctccattccttcaaccatgaaacaattcacagcagtcttaatggctctttttttaaaagatttgttatagaattatctccttctacttccactctcagttaatccccactcagtgagtcagtgaataagatagtaagccagcatggctggtgagaaaccacaggacagaacaaagcggaccagttggcaggagactctgtagcctgttttgttagcattcaactctgcaccagctgccccccacatgaccctgcacacacttcaggggtgcacatgatgactgctccatgacaggaagaaaatatgagaaattctacttatagttaactttttagcctctaaagttttctactttgtttatattttataaaatataaaataataaaatactgtgaatat

SEQ ID NO: 75059 - DNA, 498 bp, Homo sapiens
gagaaatcaagaccaacaaccaaaggaggaggatgaggacagggacatgaggaggaggatctgcatgagaagccagaatggcagctatgtatacgtagctatgtaatggaagattagcagccaaatgcaatggcctttagaaaagaaggaaaggtgataataaaaccaagatctcaaaactgaacttgagaagggaaataaattaaattattaactttctgagtttttaaaaatcaaaataagctaggtgccacggtgtgcacctgtagtcccagctgttcaggaagctgagttaggaggatcacttgaacccaggagttcaagaccaacctgagtaacatagcgagaccctgactcaaaaaaagataatcaaaataatctcttggcatattgtgtggtatgtacacaaatggattacttctgtctctaccaattgcacatttcattgtccatttagcacctctttcaggagttagacagaaaacaattgcattaagt

SEQ ID NO: 75060 - DNA, 1176 bp, Homo sapiens
tcacaaaaaaggttaagaaatgacttaatggaagagattcagaagacccagaccgaccttacagggatgagaaactacaatattgacagtggaaactatcctggatggggtaacagattggatttcacagaagagaccatgaggcaccttgaagacacatcagtggaaactatttgcatttgttgggcctccagagagacagaaccaataggagatagctagatatatatacagacagatagatagatagatagatcgatagatagatagatagatagatagatagatagatagatagatagatagactgacagacagatgagaggggccttaggggcattggctgacacaattttggcaggtcaagagccccacaataggccatccacaagctggagacccaaggaagctgctagtgtgcccagtccgagtcctaaagcctcagagccagggaagccagtggtgtaattctcagaggccaaagcctgagaacctggaggccactggtataagtctgagtccatagacccagtgaactccaaacacaagagatacgagtgcacatcataatcaaattgcatataaccagtgataaacagaaaatcctaaaaccagtcagaggacaagggcatgttctgttgggaggcacaaagctgatgaggatggctgactcctcaggagcagcatgggtgagaggcagtggaatgtactaaggagaaaactgccaaattcacattctgtacctgacaaaatctttccgaagcgatggtgacataaagacattttcatacacacagaaactaagagtttcatccccagcagacctgcactacaagaaatgttaaatgatgtgcttcagggaagagaaaaatgaagagcatgtgcaccatccaggattttcctcgttatttgaatccctttggcccatctcccatttgccccaaggaatgagtgctggcagtgagctgcactttttttttctctaaacgggaaatgggttaaaagatgagtggcttggccgggtgcggtggctcatgtctctaatcccagcactttgggaggctgaggccagaggatcacttgagcccaggaactggggggtcatgctgggaaacatggcaagaccgcatctctattaaaaataaataaaagttaactgactgtttaaacaaaagt

SEQ ID NO: 75061 - DNA, 1122 bp, Homo sapiens
gccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaaaca

SEQ ID NO: 75062 - DNA, 515 bp, Homo sapiens
gccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcaaaaaaaaaagtcgacgcggccgcgaatttagtagta

SEQ ID NO: 75063 - DNA, 543 bp, Homo sapiens
gatatttaatttgccacggcaaagccattgctgtgaagaatggataatatatgtcaatggtaatatatgaagaaataacacaggtgaatagcagaggcaataaatctgtttttaccacaggacttgtcttacacttttctcttagtaataaataaaataattttcgaccagatggagctggcttgaaatcctcttgtttatggcagtacatatcggttatgattcaaaaaatatagcccatttccaaaaacctgcaacaaagagatactttctcaggtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaa

SEQ ID NO: 75064 - DNA, 1208 bp, Homo sapiens
gatatttaatttgccacggcaaagccattgctgtgaagaatggataatatatgtcaatggtaatatatgaagaaataacacaggtgaatagcagaggcaataaatctgtttttaccacaggacttgtcttacacttttctcttagtaataaataaaataattttcgaccagatggagctggcttgaaatcctcttgtttatggcagtacatatcggttatgattcaaaaaatatagcccatttccaaaaacctgcaacaaagagatactttctcagtcctgcaggctgtacaggaagcacagtggcatcttcttctggagaggcctcagggagcttttactcatgacagaaggcaaagcaggagcaggcacttcacatggtgaaagcaggaacaagagagagagagtgtgttggggtaggtgcactaccatggagacagcaccaagtcacgaaggattcgacctcatgatccaaacacttcccaccaagctccaccttcagcactggggatctggtttcaacatgagatttgggcgggacatccaaactatatcatctgtctccctcatccaagaccatgtgatccgtagctcacttttgtctagcaacagattaaatacagcattttctgtgtgatatctttgttgaggtctttgcagatggctgtttctttgtcctgaaactttcttcatctgctctttcaaaatgagtgactcttcatcctcgaagtctatgcttatatattgcttttcagaggaatcttttctgaactgggcattctgccttcaaccaactattttctattatagtttcctgtttgtgagttaatagtccttttgaaaatttgactactcatttaccttcttgggttatttgaaattatctcctcttcactagattctatagaagcatagccatgcctgccctctttactgtttctctactgacttgttgcaatgaatattgtcagtaaacatggaaataaatcagttattcagatatcctaccttggtgcttgcttagataactccacactgtgatgcctaatgacctacacagggctttctagcaaggagtgactttctttctgctacgtgtaataatgatccgtcaacttaaacatatagttatatttccagcagacggtttcttgaaactaatgtccagggtgtagttattcaaaaaagcaaactcttctcttgatttct

SEQ ID NO: 75065 - DNA, 506 bp, Homo sapiens
gtgccatatgtgcctgggcctttttctgacacccctgagttcacctatcagccccagcagcctgggcaggattttccggtttcaccatggctcaccctctgtcctgtgggctgcccagagtgtccaccccatctttgggacactgaggaacatttgaagttaagcagtgcttccttgaaagtttactctaagctggctctggggccacttcaacttcagaggagtgtggcagggtccttcctggaagctgtcatcatgcactgcaggacagcacagccaagatgcacctcctgcttgtcacgtggtccaaacctggcacccacgacaggcagagcacggggccactagggtgctaacctgggcccattccctgcaaaaactgttctctgtcctcagtaactattcccaaaatgtaagccttttgccctcaagtgtgaaagagtatattaagctcattgcaagtttactccagcccgcaaaaaagcaagagacaatcttgtcccact

SEQ ID NO: 75066 - DNA, 505 bp, Homo sapiens
tcactgagaaggcccctggaaacaggacttcagcacacaaaccctgcatcagagctgcttccggtctgagtgaaggtggagacctagggaagagcagtgactttcgtagatgtgagggaggaaaagggagcaggtgtgacggatccttccagtcagctggcatggggcccctccctcgtctgttggaactaagggcgcctctgcgtcccgcccctccgcacccccagcagtatgcctctctagcatgcttccggattcacctggagtttggtttatagttactgtgccaatggtagtctcttagttctatagatgtgccacggctatgtgagatgttatcagtatacaggagctatttgtactatctttgtagtttttagattcttccaaaataaaaagtttattataaaaaccccacaaccaacagcagattccagctgttggttgggggcagggaagggggctaatgaggggagaggccaggccccagaggggaactggggtg

SEQ ID NO: 75067 - DNA, 280 bp, Homo sapiens
attagaaatacaagaactcagtaacctatgggtccgggtaacagggctcgacatagtgagtttcagtgtgcttgagcctgcgttgggatgtgctgtggccatgagatgtaacaggtgtgtcgggcacgtgtagcttcctggccagctctggaagtgcaaagccagccttggcctcctcacctgtaaggtgagactggtgattgatgagttactgatctgtggcaaggatcagtgaggtggtgatggaagaaaggactttggtgacaagcttttgacagag

SEQ ID NO: 75068 - DNA, 639 bp, Homo sapiens
gttgtataactatttcattatatattacgatgtaataataataagagtaaagtgcacaataaacgtgatgtgcttgaatcatccccaaaccatcccccacccttatcctgtccatggaaaaattgtcttccacgaaaccaacgtagagaaaaacagagctaagacaaaccaaggctaactgctgatttaagtccctagatccagctattcttgaagccttctcagttacacaaaccaataatacttactttttttacttaaactattttctgtttccattacttacaaccaaaatagtcctgattaatacatagaataatgtgaatttttatttttattctgatttttattctgactttataaaaaagaacttttacaattatccattatgcttggataaatgcgtgtgtaaatatttgtttggggtggaggatgtacactgaaatgttaacattagatttctgcggaggatgagttggaaggaatgaaggagacattaatatctttttctggcagggcacggtggctcacacctgtaatcccagcattttggaaggtggaggtgggcggatcacctgagatggactcaacgactctcttaccgtccagctctcaagtcccttctcttgtgaaaatgga

SEQ ID NO: 75069 - DNA, 1021 bp, Homo sapiens
ggagaccattcagtgcacaatggatgtctgcatacacacatttaagatttgacaggatacagtgcaccagggggactattacgatgactaccagaaaataataccaagagaccaaagtgtactccttcacaggaggccctatgaacaaaaccagtcaaaaccaaacaagtcaaagtccaggcatataagcagctcaatagtatttgagtccaattggtcataatctttgtttggggtgtgatggtgattaagtattcaccatcacaccccgaatatattcaataataagtcaggttgctgggctagggcattaatagtacctataaagaaggaaaaattgagaaggggagacctcaaattagtttccttaggagatataaccaagtggtgataacttcactttcccaacctttttaaagttgtatgagctctaagtccctgcatttataatttcacatctgggaaaaaaataataataaagaggtatcagtttatgtcattagcctggtactgtaagtcatagtaacctggagacccaccagaaaaaaacataaagattccaaaaccctggaaaagctaagcttgccattcatgaaaagttttggacatcgatagtggtgatggtggcacaacatcgtgaatgtacttaatgccactgaactatacacttaacatagttaaaatgattaacttcatgctatgtatattttaccagagttaaaaaaaattttttttcttcatctattgaaattttcttcatgtatttgataaaagtatctaaagaaatagccaccttttaaattaagctttccatagtagcaaaatcaggggaagtgtagatacagcactcagtttgattcagcacaagtccccaacatgatcaaaatgatgtaaagctgcatgaggctgggtgcaggggctcacacctgtaatcccagtactttgggaggccaagatgagaggatcacttgagcccaggagtttgagaccagcctgggcaacatagggagaccctgtctct

SEQ ID NO: 75070 - DNA, 428 bp, Homo sapiens
gaaaaagagggtttattagaggtaggagaacaagacaattcaggtataacatagatgtagcatatgttatgtaaaaaggtttttttattttgaagaaatagacaacaaaaaataggagttttctagttaaaggcctcttttgcacgtacacgtgaatacacatattgaaatatttttcctggcagtttttcagggatctcatatttttagaccatgtgacagaggcttggaaagtttttatttgaaatttaaccaatcatatggtttataatgaaatgggaaaagttcccttgtcctgacagggtgcgtgatgcggggtgtggctcacttcttaagtgccccgctgctcagacctctaggggaccatacagacaggtaggctgtggggctccgactcacaacagtgtctaggagtgaatgtttacagc

SEQ ID NO: 75071 - DNA, 426 bp, Homo sapiens
tggtgttggtgtaatctatggagcttattcagatttcactagatagacacgcacttgtttgtgtatgtgtaactctgtgcgtttttatgtcatgtgtacagccttgcataaccaacaccatgatcaaaatacttatctgggctggatgccgtggctcacgcctgtaatcccagcactttgggaggccgaggcgggcagatcacttgaggtcaggagtttgagaccagcctggccaacatggtgaaacctcatgtctactaaaaatacaaaaatttgctgggcatggtggtgcatgcctgtagtcccagctacttgggaggctaaggcaggagaatcacttgaaccctggtggtggaggctgcagtaagccaagactgtgccactgcaatccagcctgggcgaaagagcaagactccgtctcaaaca

SEQ ID NO: 75072 - DNA, 456 bp, Homo sapiens
aggaggatcttccctcaaagatggattttcttcaggcaaggtcagcctgttatatgaatacttatgaatataatgcatattttatgatttgatttctctgttctctttgtttacttaattcaaagttaactgcggcctttctttatgctagtcttggcatacccaggagtaaaaagaaaattggagaatcatgaccttatttatgtatatctgcagcaaccgaatagtaaacataagcattgtaaaagataaaacttgagaaaacagtacattggagttatgactttgttgtgtcatatatacttctcactagagtatggtagtcaaatacaccttttttgcttttatccctgtctctccaaatatttagttaaagagtaaatgtttaagctggcttggctagaagtagttatttacctaccatattaagggataagatagaggaaatggaaggga

SEQ ID NO: 75073 - DNA, 368 bp, Homo sapiens
ttgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtc

SEQ ID NO: 75074 - DNA, 750 bp, Homo sapiens
gaaaataatccaaggttcattaaaacccactcaaagtatataagtgaatgattaggtatagtagataatgttctgaattgccctagtttcatcccctctcatctgagcttgtgagtgttacatggggtcttccacctcccacacagcacagttctggtgtcttcagtgggtgctaccggccctctctagcattcattattgccacattgtattggccaccttctcctaactttttgtgcctagggactatcagggcccagcattgtggtggtgggactagatgactttcaaaccccttcctactttagtgttttctgatttttgtaatgagacaatagccatgtaagcttccatgttgatctatggggcttaactgattgagcagcctcatttaggagagctcacaattcttagagcaataagtctcaatgtcaataacttgtttgccagttgctcagcacagtgtatatacgtgcctgtgttcctgactgcttaaaagctggctgtgtgtggtggctcatgccgataatcccaccactttgggaggctgaagcaggtgggttgcttgagcttaggagtttgagaccaccctggccaacatggcgaaatcctgtctctaccaaagatacaaaaattaggtgggcatggtggtgcatgcctgtggccctagctactcgggaggctgaggtgggaggatcacttgagcccaggaagtcaaggctagagtgagctgtgatcacaccactacac

SEQ ID NO: 75075 - DNA, 388 bp, Homo sapiens
aattcagcctgcaactggaaccctgaattcactcaggaaatgtggcagtaatatgtgagacatatttctggttctgagccagcctcgtaggcacagtaacaccagggacttaaggttgaaaatgtggtttcaataagaatgttctcaaggaaatgtgtgtattggagataatttagatctacgtggagacttgcacagacctctacaaagccctaggaagaatatccgagatctgtataacataaaaactgtgagtctagtaaaaagctcagattccttattagagcctttccttctttgctcagtattacaggctgccagatagtgtagtttctctggaaaatcttgatttttattaagggcttatctagaacaaattatatgacag

SEQ ID NO: 75076 - DNA, 417 bp, Homo sapiens
ttttgaggaatgttgagaatatagcagtccttgcagccgatgtgtcatccccgaatcgctatcgtgtatatatcgctggcacttgcccccgacatatgttggtgttaatgtaaggtaattgtacacccctggctacacatactaaagcttgaagttgtagctgctaggaacgaaccatctggcacccttcctagcctccttactgatgcttgcaagaacggtttagctgatcctggtgagagatatttgaactactattgtcttgcacctaattccagctttcaaaagtctgccttggacgggcgcagtggctcacgcctataatcccaacactttgggaaactgaggcgggaggatcgcttgagcccaggtgtttgagaccagccaaggcaacttagcgagacccttgtctctaca

SEQ ID NO: 75077 - DNA, 625 bp, Homo sapiens
  misc_feature (80)..(80): n is a, c, g, or t
  misc_feature (86)..(86): n is a, c, g, or t
  misc_feature (94)..(94): n is a, c, g, or t
  misc_feature (111)..(111): n is a, c, g, or t
  misc_feature (149)..(149): n is a, c, g, or t
  misc_feature (160)..(160): n is a, c, g, or t
  misc_feature (165)..(165): n is a, c, g, or t
cctctctgagactcagttttgcaatctataaagctagtatcataatacccatcataaggttgttgttaggtctaaataantttatntagctaanggtgtttatatattttnaaattgtgtaaagtattaattagtaattatccttagtnatacataaatntatantaataagcagtcctatttggcactacttttggattaattttatctttaaataaaatatatttttcttgtgattcagctttttcattaattcagattacatctctataattaatgtgaactaacatggttttaatgtgacagattaggattcagccttttaatcttaaagaaaatattgagcagtaagaagataaagtatgtaatcttagactaaaaagacatagacccatgttacttggaacatattttaacatattaatgaactgaaagaagaaaaaaaatttttttttaaattttgtttctgttatttactttttagactaagaaatcaacaaatatttcttgagcactgttttggtgtcactcttattttcctttttccaaccatataactgaatattttcacaaataaactcctactaagggaaaatgctatttaagtagttaaatctaattagaa

SEQ ID NO: 75078 - DNA, 617 bp, Homo sapiens
attgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatacacttgggcctgatggatctttcgaaagtgaaattgtggccccatgatggcatcatttgaaagccctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataa

SEQ ID NO: 75079 - DNA, 648 bp, Homo sapiens
tactcaagacaaacatccacgagtcacaacttcagttattcccagtcttcaaaataacagaagggcaaagcaaagtaaacatgcaaaagcaaactaaaatctgattcttcttattagaaagaagagtgaatttctgcaattattttacatttgagaatttaatgtgatcaggtcataggtattctcacaacaaaatttgaagcatttgcttgactttatttcacctgttgaaacaaaagcagttctcagtatccaagtttattgctttactaaccaatgtctctgttttttgctttacaaacatggtattggttctcacaaattagttcaacttcccggtgcattcataaacatatacccacgtttagttttccttccagtgcacaaagtttccccagtaacctaaaagtactaaatgttctacattttgtgacttgtgttctttactttttggaatataaaaataatccttaaagtttaatttaaactgggagcagtgaattaaaaaaaaaatgtaagcttgaaactattgaaaagatcatgaaaatgcagagtattttttaggatgaagctcttcaaaaagaagaaaatttggtgaatctctgtactatagaaatggctgtatcaattggaggtaaaaaaaaaaaa

SEQ ID NO: 75080 - DNA, 1638 bp, Homo sapiens
  misc_feature (813)..(813): n is a, c, g, or t
  misc_feature (910)..(910): n is a, c, g, or t
  misc_feature (952)..(952): n is a, c, g, or t
  misc_feature (956)..(956): n is a, c, g, or t
  misc_feature (1149)..(1149): n is a, c, g, or t
  misc_feature (1175)..(1175): n is a, c, g, or t
  misc_feature (1177)..(1177): n is a, c, g, or t
aatatatgagaccttaaaagctttttattcttaaaacacatgcctgttcgccagttttgttgtaaggtaaaggtgcatgtctttgagcataggtccagaatggagttatcctgccccttcttgcataagctgcactcagatgaatttcctacagtttctatttttgggttcttttttaagtggcacatgaaactagatatgcatgaagcaatttttaaaaaaactttttattttgaaataataatagactctcaggaagttgtaaagaaactagagaggtcattgtatatttgcgcatactgccccagtggttacattttatgtaaccataatagagtataaaaacccagaaattgaagttggtacaatgtgtgtgcgtagttctgtgccattctatcaagtgtctgtaaatataactactactacaatttcctatgcagaactgtttcatcaccagaaagatctctctcctgcctctcttctgccaccatctctaactcctgccaaccactgatctgttctccatctctataattttgttactgtgagattaccaagtgatatgtgaccttcggaaatgattttctttactcagcataatgccctcaggtccgtcaaggtttgttgagtatatcagtagctaaactgggaccatttatttgtctcttcatctaatcatcaattaaaaatgaccacgcataaatgtaagcttttacagttaaacttattgtatataaatattgtcacttcggctgggcgcggtggctcacgcctgtaatcacagcactttgggaggccgaggagggcggatcncttgaggtcaggagttcaaaaccaacctggcccccatggtgaaaccctgtctctactaaaaatacaaatgagccaggtgtggtggtgtgcgcttgtnatcccagctacttgggaggttgaggcaggagaactgcttgancccngaaggtggaggttgcagtgagccgagatcatgccattgcactccagcctggccaacacagcaagactccttctcaaaaaaaaaaaatgtcacttcatgcttagaaatatcagtagatggccgggtgtggtggcttagcctgtaatcctaacagtttgggaggctgaggtcaggagatcgaggtcatcctggcnaacatggtgaaaccccatctctactnanaatacaaaaattagctgggtgtggtggcacgtgcctgtagtcccagctacttaggaggctgaggcaggagaatcgcttgaacccaggtggcggaggttgtagtgagctgagatcgcgccactgcactacagcctggtgagagagcgagaatctgtctcaaaaaaaataaaaaagggcagtagataaaaaaagtacaaacatgagtatcttgataaattctattctcaggctttcaggttcataatcctgttgatagatgacatgtagaaatagaagaatttgtaaatataggaatattcattgatgtttttaggactggattctaagggtggtttttacctctaatatccaaatactgctgcctcaagagaacaatttttgttttcaaaattccatgataaaaaagatgcagtaaccctgtatgtggcattttgtcaggttaattaagagcattttgcagc

SEQ ID NO: 75081 - DNA, 519 bp, Homo sapiens
cctcttttctgccataaacaaaacagaagcagtgaggtgtgagtatgaggacacacacaaagcctttgcaaaagcattttggagaatggataggcttttaggtcttggaagaaaagaagtgtccagggttcaatggagtggctgctctgcagttacttgtatattggaaggcaaacctaaaagtccttatgctcataagaattggaaaagaaaaaatacccatgatgggttggcagagagctccccttcccaggagatgccaaaaataatttctggaatattacatgttgcaaacactgatgtgattctgggtgtcatctgtcacatttgtaaaatgagtatattatcacacaatccttcgcaactgtgccagcacttccctagcaaactgcaaacttgagtttttcaggaaaacagtttacatgagaaaaggcaagttctttcccatttcgaatgaagtaccattaaactctgtcacctagtgaaaaataataaaaatacttgcaacttttaaagggt

SEQ ID NO: 75082 - DNA, 395 bp, Homo sapiens
ttttacccttgttctgtatcttaagcccttttgttagatttgatagtcattgttgcattgagctcttttctgaaaggtaagaacgtatttttgtcaaacacattgctataatgagtatgatgtgtggctgccattcttcagtctttcttcatttacatgtatcatcaatataatgcaaatactgtcaagggcagcattatctccttgaatctattttttgttttgttttttagtataggtttgtatttgtgctggtgcaggaggaagggggaaagtgttgggaagaaacatagaaagagagaaagaacatttactttctaacaaattttgacaatttgtttttctctttttttggtaatgatcaaaattatatattaaagaacttcccaaagcaa

SEQ ID NO: 75083 - DNA, 206 bp, Homo sapiens
tcttcccaagaacatcattgttttcatttacattttcaaatttattggttcaaaattctacataaagtgagaaaataaccaagtcttctttgcagtatatccctatacttatacctttatctaggcaataaatgctagagctgtcctttcacagatctggaaattaggttagctattttcagcgcttatggctctgttcttggagt

SEQ ID NO: 75084 - DNA, 2918 bp, Homo sapiens
tcttttccttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcggcaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagagacctttgatctaaaaactccccaagtcactaatgaaggagaaccagagaaggggctctgtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcagaaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgtt

SEQ ID NO: 75085 - DNA, 2959 bp, Homo sapiens
tcttttccttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcggcaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagagggcagtgatgactgttcggaaatgtgtgatggagaagagcgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcagaaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgtt

SEQ ID NO: 75086 - DNA, 764 bp, Homo sapiens
tcttttccttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatggtaactatagctctcaacagctttgggggattcaagcccatttcattcattgattcattcattcactcttcattcatatttgacaaatatttgactgagtgactattacatgccaagcccagggggaatataatgatgaaaaaacacacatgtcccatgtccttatggagtttacatacagtgggagtgacagacgttaaccaagtaatcctgcaaatggttgctcagccaggacttgattt

SEQ ID NO: 75087 - DNA, 3658 bp, Homo sapiens
  misc_feature (1322)..(1322): n is a, c, g, or t
  misc_feature (1326)..(1326): n is a, c, g, or t
tcttttccttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggtttccacaaatgctgtggtctgttgtagtctgttcatgcttaccagcaagatgctgaaaagtaaacttgaaactccatttaatgagatgggcttgcaaacttgtgggcttcactgagcaaataccaaatccctgaaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcggcaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttntctncagagacctttgatctaaagactccccaagtcactaatgaaggagaaccagagaaggagctcagtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcagaaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgttaaaaaaaaaaaaaaaaaacaactccgaaaggaacccaagcgccgggtgcgcggacaacgaggtacaggacagggcccagagccaaagctggtaccctgacccaagattcccggcccacaacggggataaaccggcacggaccccataaaagaggaaccagataacatcaccagaaaagccagggtaaaccgtgactacagaaacgccgaagaacaaacagcacgcacaagcgcggcaacacccagcacaccagcacacaagcacgcaca

SEQ ID NO: 75088 - DNA, 839 bp, Homo sapiens
tcttttccttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaaa

SEQ ID NO: 75089 - DNA, 671 bp, Homo sapiens
gggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagttctgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatgtaagtaacaacagcaacccatgattacaggctgccatgacattacctgaccct

SEQ ID NO: 75090 - DNA, 977 bp, Homo sapiens
tcttttccttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggtttccacaaatgctgtggtctgttgtagtctgttcatgcttaccagcaagatgctgaaaagtaaacttgaaactccatttaatgagatgggcttgcaaacttgtgggcttcactgagcaaataccaaatccctgaaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaaa

SEQ ID NO: 75091 - DNA, 3251 bp, Homo sapiens
  misc_feature (1184)..(1184): n is a, c, g, or t
  misc_feature (1188)..(1188): n is a, c, g, or t
tcttttccttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcggcaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttntctncagagacctttgatctaaagactccccaagtcactaatgaaggagaaccagagaaggagctcagtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcagaaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgtt

SEQ ID NO: 75092 - DNA, 3440 bp, Homo sapiens
  misc_feature (1104)..(1104): n is a, c, g, or t
  misc_feature (1108)..(1108): n is a, c, g, or t
cagcaataaaaagaatgaactgttatcacatagagcaacatggataaatctcaaaaacattatgttgagcaaaataagcaagttgtaagagtacatactgcatgatcctatttatataagtacaagtacagacaatacagacaagtacagtgccagaaaggaaggcgccattgctggtgataggaaccagaacagtggtgtcttaagcacaaagcaattttctgggatggtggaaatgttctgaatcttgactgggatgttggtttcacaatgatttacacttaagatatgtgcctctcaatgaaaaaaaggggaacaaggctctgttggacctcgggggtgggagatcctggggcttggacatcaagttcatcttgagcacactgaggtctctcctctggtcactgtctgagtttggtaattttcacattgttttcctcagtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcggcaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttntctncagagacctttgatctaaagactccccaagtcactaatgaaggagaaccagagaaggagctcagtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcagaaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgttaaaaaaaaaaaaaaaaaacaactccgaaaggaacccaagcgccgggtgcgcggacaacgaggtacaggacagggcccagagccaaagctggtaccctgacccaagattcccggcccacaacggggataaaccggcacggaccccataaaagaggaaccagataacatcaccagaaaagccagggtaaaccgtgactacagaaacgccgaagaacaaacagcacgcacaagcgcggcaacacccagcacaccagcacacaagcacgcaca

SEQ ID NO: 75093 - DNA, 1261 bp, Homo sapiens
aagtaacaacagcaacccatgattacaggctgccatgacattacctgaccctgaaatgggccctcgtgagatttgtgatcttaatcccacggggcaagagcacacgctgtcgttagttgccttcaccttgttgtatttctgctggattttatgggaatccacagaaggtagacactgaactatgctggtagcttttccattggtatatttgtcaccagattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgttaaaaaaaaaaaaaaaaaacaactccgaaaggaacccaagcgccgggtgcgcggacaacgaggtacaggacagggcccagagccaaagctggtaccctgacccaagattcccggcccacaacggggataaaccggcacggaccccataaaagaggaaccagataacatcaccagaaaagccagggtaaaccgtgactacagaaacgccgaagaacaaacagcacgcacaagcgcggcaacacccagcacaccagcacacaagcacgcaca

SEQ ID NO: 75094 - DNA, 2709 bp, Homo sapiens
  misc_feature (1104)..(1104): n is a, c, g, or t
  misc_feature (1108)..(1108): n is a, c, g, or t
cagcaataaaaagaatgaactgttatcacatagagcaacatggataaatctcaaaaacattatgttgagcaaaataagcaagttgtaagagtacatactgcatgatcctatttatataagtacaagtacagacaatacagacaagtacagtgccagaaaggaaggcgccattgctggtgataggaaccagaacagtggtgtcttaagcacaaagcaattttctgggatggtggaaatgttctgaatcttgactgggatgttggtttcacaatgatttacacttaagatatgtgcctctcaatgaaaaaaaggggaacaaggctctgttggacctcgggggtgggagatcctggggcttggacatcaagttcatcttgagcacactgaggtctctcctctggtcactgtctgagtttggtaattttcacattgttttcctcagtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcggcaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttntctncagagacctttgatctaaagactccccaagtcactaatgaaggagaaccagagaaggagctcagtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcagaaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggtaagtgacatgcaggcgtctctctttttgtcctttaagggatcttccacctgccatgcgcactctccagcagagtgccggcttgtgtctagatggggaaagagcaggttcatcgggtactgggacccagcagtgtgatccagagagcagtgggagacgctggcagcaggaggttaatgtcctctgtgctctcagggacacctcctctgatatgctgagggcagtgttggggacctttgcctacataccggcattgtcctttccttgaagttttgcagctgggtgggttggagacaagaaacaccagttgtttatattttgtgcttattcatacaagacaggaagcacgatctcattgggctgttggaggcccgaggtccctggggctgaaaacccagtttctgaaactcaggcctgacagacagggttccctgtgctcccagcagctcagacagagaaaggagagtccacactcacggtgacaccaccttcctcagac

SEQ ID NO: 75095 - DNA, 572 bp, Homo sapiens
acgcgtccggatgaggtatcctcaagggcactacgactgtgcccttggggatgaggtatcctcaagggcactacgactgtgcccttggggatgaggtatcctctgaaaatggtgtctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75096 - DNA, 1675 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75097 - DNA, 811 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtcccggacttaccgatggctgttctgaaatggagaggaaagcccgtgccaaa

SEQ ID NO: 75098 - DNA, 1769 bp, Homo sapiens
  misc_feature (1769)..(1769): n is a, c, g, or t
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaaaaactaaaacaacaaaaaaatataaaaaagattaatgaaccaagaaaatcacaaaaacagaaaactcttaatagcaagaaacatacatgaaaaaaaaattgcgcccgcaattggggctaacn

SEQ ID NO: 75099 - DNA, 1621 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75100 - DNA, 1620 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagttgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75101 - DNA, 1865 bp, Homo sapiens
gcgcaggctgacggcgggcgggggtcgcctgctccagctcgggctcccgcgccagaaccgggtccagaaccttgattccggaagcgggcaacggggtggttggtgggcgcgcctgagggaagggacgtgaggagccggagtccgcggagttgccgcggagttgtccgcggagtccaggcgggtggggagcagagcagctggaaccccccgagcgccctgcagacgcagcagcctcttgaggggagggtctcccccacctcgggctggacaaagacagcttttccccacgtccctctgggttctctagagcaacagcaatacccgcccggcaggggtgtggcttagagccccgcacctcctcgccgcgcggcgggcctgacttctagccacgggtctccgcagttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75102 - DNA, 2064 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggtgcgtatctgctgcctagcagggcccagtcctcttgcagaccagcggtgtggggagccctggctgggactcctagactgcatctgaaccacagggacctacggacaaggagagggtctcgtgagtccccagatactgcattttacaactctaggttccagctacacagttcagggagcaagggtggccattaaacacgtgacttgtatcctaaatactgttgaaaagcaaaggaaactcaaacaggttcagacattcactatctttcgtaaactggcagttttcagggcaccttctcacaggccttggtgaacctcagtgggtgactgagcaggtggaggagtctcctcacccccatcttctggttgccctgactgcctgttttgtaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75103 - DNA, 1715 bp, Homo sapiens
  misc_feature (1715)..(1715): n is a, c, g, or t
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacagtgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaaaaactaaaacaacaaaaaaatataaaaaagattaatgaaccaagaaaatcacaaaaacagaaaactcttaatagcaagaaacatacatgaaaaaaaaattgcgcccgcaattggggctaacn

SEQ ID NO: 75104 - DNA, 1611 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75105 - DNA, 1596 bp, Homo sapiens
gaaagaaggtaaattgacagcatgaagtagagcacccaggagaggctacatgtgatgaagaaaccacagtgcagactgtgaggaccccagaaaggctcctccccaaaacctgaccagtggccggtgctggcagctcccaggctgggacacccctctgtctctctgtccctctgccccctctgtcacttctttatacacctgtaaatcctgccctgctctccaaggccctctgtagcccatttctccccaaaatgggtatttagaataaccttctgctggcccctctgccttaggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75106 - DNA, 1514 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75107 - DNA, 1551 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaaggccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75108 - DNA, 1626 bp, Homo sapiens
gtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75109 - DNA, 1542 bp, Homo sapiens
gaaagaaggtaaattgacagcatgaagtagagcacccaggagaggctacatgtgatgaagaaaccacagtgcagactgtgaggaccccagaaaggctcctccccaaaacctgaccagtggccggtgctggcagctcccaggctgggacacccctctgtctctctgtccctctgccccctctgtcacttctttatacacctgtaaatcctgccctgctctccaaggccctctgtagcccatttctccccaaaatgggtatttagaataaccttctgctggcccctctgccttaggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75110 - DNA, 786 bp, Homo sapiens
gtgtaggtgggcagatggataaaagcgtgattgaatagatgggtggatgatgggtggatgcccaactggccaggaaccaatccctgaaatttgtcccattcatatcttggcagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75111 - DNA, 618 bp, Homo sapiens
caataggcgaaatggggtacggggcccccctcgagacctcgtgcaaaattcggcacgaggccatcaaggataggcaagagatgccctacatggatgctgtggtgcatgagattcagcggttcatcaccctcgtggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagatttcgaattgtttgaggtcaggatttctcaaactgattcctttctttgcatatgagtatttgaaaataaatattttcccagaatataaataaatcatcacatgattattttaactat

SEQ ID NO: 75112 - DNA, 429 bp, Homo sapiens
agtttacgttagaaaaagaaggaaaatttgggttatatgtgatagacaggactgcaaaagccaaacaacatagcttcgaggggtgtttgattagacagcccaaatattcctcccagagacatctctggggccccacgcaccccctttcctaacgtcaggatgtgtatcgacctgtgtgtgcacatttgccatgcagagtttgcactgctgaggagaatggtgcccaagaaggacactgttgacccaaaatattccaaataaacaatgattacagccacaaattcaggtttggagaaagttgttggtccaacacacacaattatgttgcatccagaaaaaagtagtaaaatatttttttccctctctagctttacaataattttcccagctttctacactacttgcctggaagccacagaaaagtcataa

SEQ ID NO: 75113 - DNA, 436 bp, Homo sapiens
ctggaaaagagcctcagcagatagtgcctgggactgtagtgaattctaatgccaggaacaaactatcacaaccagccctggggttaatcctgtgagaagattagggctttcatcttcatttagacctgacccctgactgctttctatctaatccttcactaagcaactccttcaactggaaatatactatcctatatagcataatattcaaaactacattcttcactgggggtttccagatgaaagcccacattttgttaacatgactcactgagacagtctttgtttctcctaggcacagtcgtagtgccaactctggactctgttttgtatgacaaccaagaatttcctgatccagaaaagtttaagccagaacacttcctgaatgaaaatggaaagttcaagtacagtgactatttcaagccattttccacag

SEQ ID NO: 75114 - DNA, 366 bp, Homo sapiens
ctagagatagctttcaatctcttcagaaatagcctggtgcagtgagaaaactaggtttgttttcaggccagtctgatcttcatcctattctgtctataactagttgcaggtccttgctcggatggcataattttttgatgcctccatttgcttaactagaaactaggattcatatacacactctgcactttgtattgaagattaatgataatgtaggttttggttgctgtggctgagcctggccagtaataggtgcataacagaagtagctaagagcatttcataatcaggatgaactctccaggacagccctacaaagaaggagctgtttgttcccggatggcctcgaccttccaggcttgattg

SEQ ID NO: 75115 - DNA, 481 bp, Homo sapiens
gatatcttgcaagtagttgaaagtataggcatgttgcttcgggaagaagtcagcactgagatcatagctcttggattcattattgcacagaggactgatcaaactataggagtaagtgggcttattcaggaagggtatagaatgaggaaagaaagccagtgatgaaacttgaggctgtcctcagtgtttaaggaacaaggaccaagaagcagagggagaaacactgtgaggatggaggatgtcacactgtaggatgaaaatgtctgggagaagcaatgaaattgataaatcacctgacatgtttaccagttggaaaatagtattcagagaagatcttattgttctgttagagagttcaaaaaaactgtgtaacaggaacagaaaaaagtaagccaaaaacaaaaaaagtaatgattataggagaataaaaagtttacaaaaaaggaaatttaatcagcagcatgctgcatgactcagatgt

SEQ ID NO: 75116 - DNA, 487 bp, Homo sapiens
ctctatctttacaaaaaacaaaagaattagccaggcatggtggtgcacaactgtagtcccagctatttgagaggctgaggcaggagggtcacttgagcccgggatttcaaggcttcagtgagctgtgatcatgccactgccctccaacctaggcaacctgtgagaccttatctcaaaaaaaaaaaaaagtgcttctcggtgctagcttcagttcaccaggccccccaggggtgtcaggagggcaggggcaggatgtagcatagagtctgggaaacaggctcttggctttgactgactccagccatgggtgcatgtgggcctagaatgtctctcagaaggccttaggccagagatctgcagaaaatagctcagtacgtatgtacctgaatctgggactggccatgggagcacagcttcctgcactactccttttaggcctgatggcctctggaatcaggactcttgtttgtttggccatgattatgtc

SEQ ID NO: 75117 - DNA, 792 bp, Homo sapiens
accaagtgaaaacctcggtcactaaaacttcttggaatagcattcaaggtcttgctttaacacaaaaccccaaaacttggcggtacaaaacaaccattttctgatggatcgggaatccatgtctgaagtctcagctaagaagactccaaggctgggttccaggctggaactgcctggggcatctccccacacacacactggtacttggctggaccaccagcaggttctactccccgtgtttcttcacagtttgtcagttgggctgatttgggtttgctcacagagtatcagccaagatcccaagatcaagtatccaaagagaacccggtgggacttatatttccttttatggcctagccctggaatatgtggcatctctctgtccatagtcacagagggaagaaacagatggcatctctcagtggggaaccagaatcatatggttaaaagaacacatgggatggacaggttgccaccattgttggcatacattaataaagtctgccatgggccgggtgcggtggctcacgcctgtaatcccagcactttgggtggccgaggcgggcggatcacgaggtcaggagatcgagaccatcctggctaacacagtgaaaccccgtctctactaaaaatacaaaaaaattagccgggcgtggtagcgggcgcctgtagtcccagctactcgggaggctgaggcaggagaatggcgtgaacccaggaggcggagcttgcagtgagccgagatcgcgccactgcactccagcctgggcaacagagcgagactctgtctca

SEQ ID NO: 75118 - DNA, 326 bp, Homo sapiens
aaaaagaatatgatggtctttgtaactgattctggacttatgcatcattgatgctgcagtgttaaaactacaagagctagaaaactgaagatgtcgtctgcttacggaagcgctgaaagactaggatgtgatttattaacgaccaacttctgttattgtgtgttaagtttttcatctgtgcatcaaatcacaaagaataaatagagctttttcctttatcagtcccttgggcacagcaggtcctgaacaccctgctctacaatgttgcatcaagagttcaaacaacaaaataaaaaatattaagaggatatccccatcctgtgact

SEQ ID NO: 75119 - DNA, 600 bp, Homo sapiens
  misc_feature (1)..(1): n is a, c, g, or t
  misc_feature (5)..(5): n is a, c, g, or t
  misc_feature (7)..(8): n is a, c, g, or t
ngccnannctaccgataaatcaaatgctgctactttgcatgagaagaattaaaagatagtctgaagcagtttttatagaaagaagacaaaagcagtcatgagtcatgctgtggtccagaaacctaatagcagatggccaactgggacactgaaatttctgtactgctactgcctatgtttctatcacaacaaatatcctgatccctcactgttaaggattcagaactgtcctccaagttttattggactggtccggttctaccctctttcttacttgcagttttcaagaataagtgtagaatgtgctgggaatggaatatcctgatatcagaagagaatggtagaacagcccagacttaacagtcttcacaagaaatacaatctctcaacacttttggtcagtgagtcaggtgatcctgggctataaaacctgggctgggctattttctggagtctcttaactgtgttgcaagtggggcacatgcaatcaaaattccatccttccaggcaacttctctgaacctcagggggaccacatcacactgaattttagacttctcatcttcgatccctttataagtaataaatcaacttatgtaa

SEQ ID NO: 75120 - DNA, 1023 bp, Homo sapiens
  misc_feature (1)..(1): n is a, c, g, or t
  misc_feature (5)..(5): n is a, c, g, or t
  misc_feature (7)..(8): n is a, c, g, or t
ngccnannctaccgataaatcaaatgctgctactttgcatgagaagaattaaaagatagtctgaagcagtttttatagaaagaagacaaaagcagtcatgagtcatgctgtggtccagaaacctaatagcagatggccaactgggacactgaaatttctgtactgctactgcctatgtttctatcacaacaaatatcctgatccctcactgttaaggattcagaactgtcctccaagttttattggactggtccggttctaccctctttcttacttgcagttttcaagaataagtgtagaatgtgctgggaatggaatatcctgatatcagaagagaatggtagaacagcccagacttaacagtcttcacaagaaatacaatctctcaacacttttggtcagtgagtcaggtgatcctgggctataaaacctgggctgggctattttctggagtctcttaactgtgttgcaagtggggcacatgcaatcaaaattccatccttccaggcaacttctctgaacctcagggggaccacatcacactgaattttagacttctcatcttcgatccctttataagtaataaatcaacttatgtaaaaaaaaaaaaaaaacgagaaaagaaaaaaacgcggggacaaaaataaggagagaggaaaaagagaggggaaagaaaagggcaagggggaaaaagaggaaacacgacacaaacacacagggtacacacggtggaacaaacagcaggacaccacaatgaagagacagaaaaaaaggcgaacaccagataacagaatagagcacggcgaacgaaaaaaagaaacacacgaaaagaagacaaaaggagagcagagagaacaggaaagaaagagaacagagaggagaagaaagaaaaaagagaaaaagacaagacagaagaaaaaagaaagaacaagaagaagaaaaagaagggaagagaagaaaagaagaaaaagcgaaaaaaagagaagaagacaaaaaggaaagagaagaacaaaaaaacagaga

SEQ ID NO: 75121 - DNA, 220 bp, Homo sapiens
gttttaaatgacccagaaattgcacacatcgttcctgcttacattccatggttcaaaactacatgatagttacaagggaagtgggcagacatgcactcaagaagaaggaaataacagatttaagagttggccgacagtctgccattttggtatcatatgttaataacagatcttctgttttcagagatattattagggacagaaatctcctgattcagta

SEQ ID NO: 75122 - DNA, 587 bp, Homo sapiens
tccagttgcccacatttgctaggttgtcattgactcatgcaatccttgatccctggggcaatcgcagattcctcttctgtgaccacctcccagccccacctcaagtctggccctgagttctctctgctgttaccttttgcagtggccagatatatactccctttttcaggtctctaccagtctctgatccaacctgcgcccacagccagattggcctaccctaaacaatggtctcttgtctctcttctctaaaacctccagggaccatgctctaaagtacaatgcctaagtccctacctgtggccctttctcctcccctttctctgtaaatcctttgcttctttcctttaggctcagtcacctttatagagaccaagagcatgggctcctgagtcggacaagcaaacagctcagtccctgtgccaccacttacaaactgtgacctggccaagtttcctcagggttctgtaattcagtctcatccttaaaatggaaagaaaagtctctgtcctgttgggttattttaaggattaatacctgcaaagcacttggaactgcttaataagtggtactgtctgaaaatgcca

SEQ ID NO: 75123 - DNA, 986 bp, Homo sapiens
cggaggctgggcgcttgagggctgggcctgcgggccgcgggacagggagggcgcggggccgggctgctgggtccgagctctgggcacgatgtcctccctgacgccgccaggacagcgcctggcccaggcctgggcctggtgaacgcgggtttcttcctctgaggttcaacactccgcacttgggttggctcctttcatcctgattggtttattcgccacgtgccaagcactgaagagggcgtgcaggatggatacttttggagcaaaaatagccctgcttctttcctggggagggatcgcactttctagaggggcggttctcaaagtatggtctcaggactagcagcgtcgaaaatgctgggaactcgttagaaaagcaagttttcaatcctcgccccagaatcagaaactcggggtggagcccagcaatgtgtgtcctgacaagtccacgcgcgaccccagtgctggctagggttgcaaagccactgctctacggagcgagcgagatccatcatagtgggacaagcgagaggatgaggccatacagaccagggagagaggctccttacactgacattcaaagtcctcaatgacccggccccagcctacctctgcagccttatctccctacaaaccatcaaagcagaacaaaaacctgtccctccgatttaggttttagcaaaccacaagaagcacttcataaactggtgactcaagtagaaaagtactgttccacgcacttgacaccaatccacccatttcacctgcatgatcaccctgcctttgcatgagttgccggtgtggacagagcagggacacagtgagacagcggattccagctttgctcttacctagaacacactgcctctcaccaggaatcgtccttccattttatgcagttatcccagacaatgatgcacaagctttgggaaaaaaaccccacaagtccaaaggtgtacttcataataaaggcaagttatctgtca

SEQ ID NO: 75124 - DNA, 750 bp, Homo sapiens
cggaggctgggcgcttgagggctgggcctgcgggccgcgggacagggagggcgcggggccgggctgctgggtccgagctctgggcacgatgtcctccctgacgccgccaggacagcgcctggcccaggcctgggcctggtgaacgcgggtttcttcctctgaggttcaacactccgcacttgggttggctcctttcatcctgattggtttattcgccacgtgccaagcactgaagagggcgtgcaggatggatacttttggagcaaaaatagccctgcttctttcctggggagggatcgcactttctagaggggcggttctcaaagtatggtctcaggactagcagcgtcgaaaatgctgggaactcgttagaaaagcaagttttcaatcctcgccccagaatcagaaactcggggtggagcccagcaatgtgtgtcctgacaagtccacgcgcgaccccagtgctggctagggttgcaaagccactgctctacggagcgagcgagatccatcatagtgggacaagcgagaggatgaggccatacagaccagggcaagttttgagcgtgcagatccaccagctgcttgaagccaggggcaccaggatgtctggtcccccagctcagggatcctgtctccccacaaaaagcagcagcagaagacccctctttgagttctgaacatgttcctagattttcccagtatctatggggattgagagattgataaaggctgcttggagctgaaaaa

SEQ ID NO: 75125 - DNA, 638 bp, Homo sapiens
cggaggctgggcgcttgagggctgggcctgcgggccgcgggacagggagggcgcggggccgggctgctgggtccgagctctgggcacgatgtcctccctgacgccgccaggacagcgcctggcccaggcctgggcctggtgaacgcgggtttcttcctctgaggttcaacactccgcacttgggttggctcctttcatcctgattggtttattcgccacgtgccaagcactgaagagggcgtgcaggatggatacttttggagcaaaaatagccctgcttctttcctggggagggatcgcactttctagaggggcggttctcaaagtatggtctcaggactagcagcgtcgaaaatgctgggaactcgttagaaaagtactgttccacgcacttgacaccaatccacccatttcacctgcatgatcaccctgcctttgcatgagttgccggtgtggacagagcagggacacagtgagacagcggattccagctttgctcttacctagaacacactgcctctcaccaggaatcgtccttccattttatgcagttatcccagacaatgatgcacaagctttgggaaaaaaaccccacaagtccaaaggtgtacttcataataaaggcaagttatctgtca

SEQ ID NO: 75126 - DNA, 867 bp, Homo sapiens
cggaggctgggcgcttgagggctgggcctgcgggccgcgggacagggagggcgcggggccgggctgctgggtccgagctctgggcacgatgtcctccctgacgccgccaggacagcgcctggcccaggcctgggcctggtgaacgcgggtttcttcctctgaggttcaacactccgcacttgggttggctcctttcatcctgattggtttattcgccacgtgccaagcactgaagagggcgtgcaggatggatacttttggagcaaaaatagccctgcttctttcctggggagggatcgcactttctagaggggcggttctcaaagtatggtctcaggactagcagcgtcgaaaatgctgggaactcgttagaaaagcaagttttcaatcctcgccccagaatcagaaactcggggtggagcccagcaatgtgtgtcctgacaagtccacgcgcgaccccagtgctggctagggttgcaaagccactgctctacggagcgagcgagatccatcatagtgggacaagcgagaggatgaggccatacagaccagggttttagcaaaccacaagaagcacttcataaactggtgactcaagtagaaaagtactgttccacgcacttgacaccaatccacccatttcacctgcatgatcaccctgcctttgcatgagttgccggtgtggacagagcagggacacagtgagacagcggattccagctttgctcttacctagaacacactgcctctcaccaggaatcgtccttccattttatgcagttatcccagacaatgatgcacaagctttgggaaaaaaaccccacaagtccaaaggtgtacttcataataaaggcaagttatctgtca

SEQ ID NO: 75127 - DNA, 684 bp, Homo sapiens
tactgtgtacccacaaaatttgaaattaaaagtttttaaaaaggcctcttgttccagaggccaaatgagctgactgacagtacatttttccctgtttctatctctttaacccctcttggtggctgtgactgacatgtgaagttttgtccacaccttctggagtcccaagtgtctggttgacagtgcagtcttctttttagcctctcagttttggaatgacaggttacaaaatgacttgttggaaatatcgacctgtaggtgatgagctggaaaaggtcaaatgccttctctcatgggctctcccaaaaaccaaagtgagttctctctctcagctaccggcttctttctggcatttatttttcctgccccttctccagtatggggagtgggttgttgtcggtcacaccaagcagtagccagattttttgttatttcatatggatttttttcctttcgtaacatggaggaagggccttgtcttttaagtattttacttgtaccatttggcatttgtggcctccctgagtttgtgatctgatatcccaaattgtgcttgagcaaacacatcatggcacctgtttgaagtgacgaaatcatctgcagagccttttcctgaaataacctctcagtgacctgcactttcacctttcctaataaatgcaagctcctaaataaagccttaca

SEQ ID NO: 75128 - DNA, 173 bp, Homo sapiens
gcctgccgcgccgcgatgtgggagaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccg

SEQ ID NO: 75129 - DNA, 723 bp, Homo sapiens
ctgatggcactggaggaaaacaaaggccgagagaccctgatgcccacagcccccagatcacagaagtgaggccaagatgcccatgtcaccagagccagaagaaaggctcctaccaaagaatattttacatctgctgagatgagggtgagaaacaaaatccaagaatttctgcgacgttttccccaagaaccttcaaaaagaaatacagaaaattctcagatgaaaataaattgattttgctctgggggaaagccaaaaacctttagcgaatccacactgttttatcctgagaacttccatgggtcgctggatcagcaggcaaccattatcagactggagagtcatactttaaggaatacaaatgcaacacacgacaatgtttcctgacatcagatgatgaatggacactgaagggaaaaacaggctttttttccacctggcaggaagagctgaacttggagtacacatttaaaggaagcacagagggaagacttaaacagaagaaagaagcgtactttcatggttttcacaaacaaatatcccaggagaagtgatcatggagaccaaggagaacaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccg

SEQ ID NO: 75130 - DNA, 383 bp, Homo sapiens
tctttccttctttccttctttccttctttccttccttccttccttccttccttccttccttccttccttccttccttccttcccactgaagccccatcattaatgcaaatccaccctctcctctcccctacttctctacatccacacagctgtcttttccctgctttgaaaatatgtacattagctgaactagagagctaaggtatttcactattcaaagaagagtatttcttacatatatccatatcacaaggcttttaaactatttttgactcctataatttctataactctttacaagtctgatgtagacaccaattggagaacttgagaattaagtttaatgtaaaggatatcaaagagataaaagataatagaatttc

SEQ ID NO: 75131 - DNA, 483 bp, Homo sapiens
gagacagagtccactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaact

SEQ ID NO: 75132 - DNA, 330 bp, Homo sapiens
actaggaggacattctttatatgttgagttagaagaatctccaagatatgctgtcaaggaagaatacagaaagcaagaaacaatagcgtatgctaccatttgtgtttaaaaggggggtaggaagtgactaatagactacatcaggaaaaggtgtagcaatttcccataaaactagacatacacttaccctacacccagctattctactcctgggtattgaaacccaagatgaaaatatatgcctatacaaagacttgtacaagaatgttcataatagctgaaaaatagggaacagcctaggtggccatcaacaggcaaatggatacatgt

SEQ ID NO: 75133 - DNA, 470 bp, Homo sapiens
cgccaccacacctggctaatttttgcattttttagtagagacggagtttcaccatgttggccaagctggtcttgaactcctgtacttaaatgatccgcccgccttggcctcccaaagtgctggaattacaggcgtgagtcaccttgcccggtcaccattctcatttcacagatgaacaaactgagtcttggagacatgccggatcacctacacagggtcacatagctgacaaatggccaggcagtaatttgaccccagctctgtggcaccaggcattccagacagacatgggcccagagacactcagctcatcagcagtagcctcagaattatcagaaaacacggccgggtacggtggctcacgcctataatcccagcactttgggaggcggaggtgggtggatcacctgaggtcaggagttcgagaccagcctggccaacatggagaaaccccatctctactaaaaata

SEQ ID NO: 75134 - DNA, 256 bp, Homo sapiens
aaagagatagggtctcactgttacccaagctcgggtgacagagtgaaacactgcacccaagtgcagcagcacgatcatggctcactgcagcctcgacctcctggccttaagggatcctcctcttttagcctcccgagtagctaggactacatgtgcgggccgccacacctggctgatttttaaattttttgtagagacgagggtctcactatgttgcccaggctagtctcaaactcctagcctcatatgatcctcc

SEQ ID NO: 75135 - DNA, 545 bp, Homo sapiens
agcgggctaggtggagggaaggaaggagggagccggggagtgggccaggcagcagccgggctgaagtcggcttggggagccagagggagcggagcggaacctgcggggcagaggcggcggccgcagcggcgcagctgatagcaggaacaggatcaagtcttccatacctgcattcccttcgtcaccgtaactggtacattcaggccacctgtgccaccagcggggacgggctgtacgaaggcctggactggctggccaatcagctcaaaaacaagaagtgaaagccagacagccctaacaaggcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaaaaaaacaaaactctccagcgcgt

SEQ ID NO: 75136 - DNA, 178 bp, Homo sapiens
gggccacctccctagggggtgagcgccccgcctccagaggcattcacacccgggccaaatgcacttggcggaagcaacagaactttacagcaggggccgcgtagcctggactctgcagtcgctgacaggattcaagtcctgactgccacaagattctcccagatgcttcaggacaagc

SEQ ID NO: 75137 - DNA, 426 bp, Homo sapiens
tcttgcccagagtgaaggtcagagtgccactgtgtaggacaggtggctgggagcctgctcagcaggagctgccaaccccagaaactgatgccagggcccctctaaaaggtccagccagatcatgcttcacagacatgagccaccccggccagcatttccactcagcttttgtccccactcacgaatgttctgcagcttgtcactatgtgtaccctcgagggtggctgatgagcccacatgcaggaaaaagcaggtcagataaactaaatggcaagctgaatgcctggcaaggaacgcacaaacctgccacccgctctcaccagcggtgaccacgggagcccctgaggctaccacgcaacctgcctccagaccagtgtcatctggaagtgtgggatccccagccagcggcattagtgtcatcctgga

SEQ ID NO: 75138 - DNA, 351 bp, Homo sapiens
  misc_feature (18)..(18): n is a, c, g, or t
  misc_feature (54)..(54): n is a, c, g, or t
  misc_feature (137)..(137): n is a, c, g, or t
  misc_feature (142)..(142): n is a, c, g, or t
  misc_feature (146)..(147): n is a, c, g, or t
accaaagtgggaggtttnatttccttggtcctccttccctcccaaggaagccancaagcgcccgtgaaagagccgcctccaggcccaagaaggaggttttatttcttggtctcttcctccttggataaagtccttgnatggnactnnccgaattcggcacgaggtgtttactaattccagtaactacttttggtttgtaaagttgtaatgagcagtgttcattaaaaagtaactcaagacaaaagtgtttactaattccagtaactaccatttctttttcagctagatgagtgatcggaaaatttttgttgcatttcaaaatctaaataaactacagactttatccttata

SEQ ID NO: 75139 - DNA, 3962 bp, Homo sapiens
ggggtactctagcaggatcttaaacgaccgaagactagaaaggttggagctgccgccgcctgcagtcggtgaccgcgcgacttcggccccgcccgcggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccatcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75140 - DNA, 4274 bp, Homo sapiens
tactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgacttcggccccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcggggtcttattctgtcacctaggtggagtgcagtagtacagtcacagctcactgcagccccaacatcctgggctcaagccatcctcctgcctcagcctcccaagtagctgggaccacaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccatcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75141 - DNA, 4342 bp, Homo sapiens
tttttagtagagacagggtttcaccatgttggccaggatggtctcgatctcctgacctgctgatctgcccgcctcggcctcccaaagtgttgggatgacagacgtgagccactgcacccggccaatgttttatatatttaaaacataaaaatatagttattttatatatttaatggttgtttctaagttttctttagtgatttgtctgatagtgttcctgtcagtttattgatctcttctaatttttaaggtattttaatatattaaggatatggagtttttgactgatgttacaaatacttttcaccaattgattcttaaggatttccaaataaatggacagaataatgaaattttagcattaagagacttgtttcatttagttttagtttgttttctaagaaatgtgataaatgaaatttttgaagagagcagctatttggtgatgtatgtaacatctttgacctttatttttatttgtttatttttgagacagggtcttattctgtcacctaggtggagtgcagtagtacagtcacagctcactgcagccccaacatcctgggctcaagccatcctcctgcctcagcctcccaagtagctgggaccacaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccatcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75142 - DNA, 3589 bp, Homo sapiens
ggggtactctagcaggatcttaaacgaccgaagactagaaaggttggagctgccgccgcctgcagtcggtgaccgcgcgacttcggccccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75143 - DNA, 1880 bp, Homo sapiens
  misc_feature (1852)..(1852): n is a, c, g, or t
  misc_feature (1863)..(1863): n is a, c, g, or t
  misc_feature (1877)..(1877): n is a, c, g, or t
ggggtactctagcaggatcttaaacgaccgaagactagaaaggttggagctgccgccgcctgcagtcggtgaccgcgcgacttcggccccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttcttgggttaaaaaaaccccaaaccccnaaaaaaggggnccccccaaaggggnccc

SEQ ID NO: 75144 - DNA, 484 bp, Homo sapiens
ggaaacaacgttctcccgcaaaagtaagacaatgtattaaggtggtaatcacaacctcttaattccaactgttggttaattctataggcaagaacctggctggaccctaaggcagatgtagaagtcttgtgtggtttagtaggagggggtgcgtgcctgcatggaggtggtgggccttgctttcaatttttctgcttctctttcaccatgttcctgacttgtctaaaagtgaacttttctttttccatatctctatcggatggcatgcattgccctttcttctcatttgtattagttttccttatctttatattaaggtttcaggaaaatgtaataccagttattcatcaggaaaagatataggatccctgttaataggatgtaaacttcatgagggcagggacttcattttgttcacagctgtatcctaagagcctggaataggagacataatagatcctcagtaaatattttatgggttaat

SEQ ID NO: 75145 - DNA, 4157 bp, Homo sapiens
tactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgacttcggccccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccatcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75146 - DNA, 4043 bp, Homo sapiens
ggggtactctagcaggatcttaaacgaccgaagactagaaaggttggagctgccgccgcctgcagtcggtgaccgcgcgacttcggccccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccatcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75147 - DNA, 3467 bp, Homo sapiens
atccctgagtcagggttgtggcctgctcagagaatggggcaaaacggagctgcatgctgccttcctctgcaaaccagcctgtttgctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccatcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75148 - DNA, 2105 bp, Homo sapiens
tactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgacttcggccccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtgaaaaaccatttcaatgtagtcaatgtgacatgcgtttcatacagaagtacctgcttcagagacatgagaagattcatactggtgaaaaaccatttcgctgtgatgaatgtggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttata

SEQ ID NO: 75149 - DNA, 290 bp, Homo sapiens
tcttgctgggggattccacacccatgagatgtgtgaatcttgagacttttttgctgacagattttatcgagtgctcaccttgcccatgctctgttagggtctcaacaggaagcagatgacataattccaaatagggtaatttgaggaaggttatttgcaatgagactatttacaacggtgttgggggtaggaaccacgagggaggatgcagtaacttgtgggtcagcagcagccgtgatgtcatcacttccagacctgaggcacaaagggaagggctactaccgcaaact

SEQ ID NO: 75150 - DNA, 342 bp, Homo sapiens
cacttcaacctccgcctcctgggttcaaggattctcttgcctcagcctcccgagtagctgggattacaggcacacaccaccaggcccagctcatttttttgtgtttttagtagaggcagggtttcgccatgttggccaggctggtctggaactcttgaccccaggtgatccgcctgcctcggttctctatatttaaataaacagacagcagctcagcaccgcgctgtacagagcatgggagcctgggtgtggaatgggctttccagtgtttgcacagtgacgacatcgcccagagagggatttctcagtgtatccctgtccttaatgatacttgagtgtatg

SEQ ID NO: 75151 - DNA, 508 bp, Homo sapiens
taagttttaaaaggtttgccataggcccaggatcatattctaagctaacctccaattgtggttggggtagaaaaactgccttgcatttagagtagtacatgtgtgtatgttcccaaaacattttaatagaaactctcattttattcccttagtgtctccggggtggggataagagacagttatctttttatagctgtagtgatctgaaaaatctgctgagtaatagagagttaagaggtggttgtacttgagaacagagaggttccgagaacatcagtggcctcttggctgaaaggagtctctgagaatcttcctgtgtggctttaactgaatcagcacaacagggcatgtaattcagaccatgcatatatatttcttcatcatctattctgctctcagccgtttctttcccatctgccttttcctgtctttcagaacatttctggggtgttgtttgggctcagcactgtgggaagtgaagcatttagcctagccagggactgggcat

SEQ ID NO: 75152 - DNA, 280 bp, Homo sapiens
aaataaattagaaatcttgaaaataaaaaatattgtcattgcgataaaaatcaaaaggatttccagactggaaagagctggatagaatcagtaatctgaaagatagtactgaggaattcacccagaatgcagcacctagaaataaaaagaaaaatatatgaaaacgcaagtaagagagatgaaagagagtttgaggctccaaaatacttcggataggagtttctgaagaagagaattaggtggaatggtggagaagcaatatatgtggagacactgattg

SEQ ID NO: 75153 - DNA, 774 bp, Homo sapiens
catacatatctataaaagcattcctatgatgttctcttctcttaaaaactcttccagagactcttctaaaggaatttaaaatacaagtttctgaacagatatagaataccattagttcactggccaagtaataatccacaggctggtatattttaaattcataacagtgtactctgtgcctactaaggtagagaggacacctcccggattcaaatgatcctcctgcctcagcctcctgagtacccgggattacaggcacatgtcattatgctggccaatttttgtatttttagtagagatggggtttcgccatgttggccaggctggtcccgaactcctggcctcaggtgatctgctcgtcttggcctcccaaagttctgggattacaagtgtgagccaccacacccggcctggagggattaaagtttttagtataaagaacactgtagtatggaaagaccctgtctcaaaaaaataaaataaaatccccaacttcaagcatcttctctgtttcacctctcaacatcccagggtggccctcagatctgccatagactcctaagtcctcatcacaccacatcaaaaccattccaacagccccaactggagctctctaaagtaccttatatccaaatgccaggctcatcttcaaacacttaaacacacaccgcctctcagaccagcctgttactataaacttctcagtctggcattcaagacatacatacgccaccaagccttttaatctttctccaaagactccaagaaaaaaaa

SEQ ID NO: 75154 - DNA, 870 bp, Homo sapiens
atcgcaatagagggcgactgtgcccctgaggagaaaatctgggaggagctgagtatgttggaggtgtttgaggggagggaggacagtgtcttcgcacatcccaggaagctgctcatgcaagatctggtgcaggaaaactacctggagtaccggcaggtgcccggcagtgatcctgcatgctacgagttcctgtggggtccaagggccctcattgaaaccagctatgtgaaagtcctgcaccatacactaaagatcggtggagaacctcacatttcctacccacccctgcatgaacgggctttgagagagggagaagagtgagtctcagcacatgttgcagccagggccagtgggagggggtctgggccagtgcaccttccagggccccatccattagcttccactgcctcgtgtgatatgaggcccattcctgcctctttgaagagagcagtcagcattcttagcagtgagtttctgttctgttggatgactttgagatttatctttgtttcctgttggaattgttcaaatgttccttttaacaaatggttggatgaacttcagcatccaagtttatgaatgacagtagtcacacatagtgctgtttatatagtttaggggtaagagtcctgttttttattcagattgggaaatccattccattttgtgagttgtcacataataacagcagtggaatatgtatttgcctatattgtgaacgaattagcagtaaaatacatgatacaaggaactcaaaagatagttaattcttgccttatacctcagtctattatgtaaaattaaaaatatgtgtatgtttttgcttctttgagaatgcaaaagaaattaaatctgaataaataattcttc

SEQ ID NO: 75155 - DNA, 429 bp, Homo sapiens
gcttgttgtggtcctcagtcacctggacttctgccctatgtctgatggcttctatttataaacctaaccctgtaaccaaggcagttagtctctcttccacatcccctgtgacattttcattttggcatctgcctttggctaatgctgactcctttactcattcttcttcctgtaaggtgcttgtttgccagtgcttgttcattaagtctccactatttttagtaagcttccaagctcactatgtctgttccctccaaaccactaccgtgcttattagattccatccatccattcatttgtatgtttattcttcaagaatattttcagtgttttccaataatatgcttggctctgggtttgcagacatgaatcaattcaatccctgttctagtggaaaaataaaacaagcagagagataaagaacagtga

SEQ ID NO: 75156 - DNA, 361 bp, Homo sapiens
  misc_feature (289)..(289): n is a, c, g, or t
  misc_feature (314)..(314): n is a, c, g, or t
ggctgttatggttccaaggactggatcgaaccagctcacctgctccacgttgctcatttctctcagcaaatccaaggactcagaaggaacccttcaccaactgcccattcccgcatgccgacctgcagagctaactccaagcttgctccacccaccttctgtcaccaccgtcccttttcttgtctcaaaagtcatcatgaaaatgcaaatgttgccacaatttgttgaaaaaataacaaaattatagtatgtgaaagagtaaaaaaaaaaaaaaaaaaaaaaaactcgngggggggggcccgggtacccatttnggccctttaggtgagtcgttttttacatttaattgggccgtcgtttt

SEQ ID NO: 75157 - DNA, 1037 bp, Homo sapiens
ggaagtccgaaatcaaggtaccagcaggatttttatgaacttgtgaggaatgctctacttccaagatgtgtggaatggtggaagacaaacattcaggatcttggctagagaaaacctgtgggaggaagatatttcagctaagacataaaaggtgtgaaagcactagccaagaggaaacatgtggaggaagggaatggttagagaaaaagacattcggatcaatggcagcatgtatgaaggtcctgagtggtcctagttcacctcctcagctgtgctgatgtcatgaaaaccagccttgacctcacaaactaccccttgatgatgctgaccgctggactactaatatccaactgcctgtgtcatttcttcatctttccttggtgccaaccatgcctgcatatcagggcagcattctatgatcccatggctctcacatcgacagaccacaacactaaggttaaaaggaacaaaagaaaactccaaatcacaagtaacagactcttttatggttggccaatagacagaccggattgggaaattcttttacacggcatccagtgatttccaaaaacaatttaatttcaaacaacgatccttccagatatgacatttgggaagaattgtttaaaaacaccagaagtaaatgtgaaataccagtggtttctagacaatcaaactctgcaattgttaagaagcaactggaatcagacagacctggattcagatcatagatgcacagttaaatcaaatacctttgaacaagttacttaacctccccaagcctcagtttctaccataagaggttggaatgagaggatgactgcaaaggacctgggatggtgcctaacaaaactttatctgtcagcttctccctgccacttcacaggagacccaactctctgcaacagaaaccagcttttccacttagtaatcactgtgtgctttagtttcctggtttataaaataggggcattgagctctgcccagagggttattatgagaacaaatgaaataaagcatgtaaagtgtttagtaca

SEQ ID NO: 75158 - DNA, 351 bp, Homo sapiens
acaaacttttcaccattctaaagaacccactttccttatcaaccaagctgggcttctctctagtgactcctattctagcctttccccagaaacagagagtgttaatcctggtgaaaatataaagacagacactcagaaaaagagacctgggactgtgatactatcaaagcttcttatgtctcccacccgcctccacagatcttggagacatctcagcgttaatgaggactttgccaacattccagactgccgtcctgcaatgaagctctgagtcacggtctgtgaggctaagtactggcaacggttgaatccccaggacaactacctcactaaccttcactctaacaagag

SEQ ID NO: 75159 - DNA, 807 bp, Homo sapiens
ggaagtccgaaatcaaggtaccagcaggatttttatgaacttgtgaggaatgctctacttccaagatgtgtggaatggtggaagacaaacattcaggatcttggctagagaaaacctgtgggaggaagatatttcagctaagacataaaaggtgtgaaagcactagccaagaggaaacatgtggaggaagggaatggttagagaaaaagacattcggatcaatggcagcatgtatgaaggtcctgagtggtcctagttcacctcctcagctgtgctgatgtcatgaaaaccagccttgacctcacaaactaccccttgatgatgctgaccgctggactactaatatccaactgcctgtgtcatttcttcatctttccttggtgccaaccatgcctgcatatcagggcagcattctatgatcccatggctctcacatcgacagaccacaacactaagccaacaatgatacggcgtccaccagcagttgtttgctacatttgtggtcgtgaatatggaacaaaatctattagcattcatgagccacaatgtctgaaaaaatggcataatgaaaacaacttgttgcctaaagagttaaggagaccagtacctaaaaaaccagaagtcaggaccattactgccaaaggcttctatgatcttgatgctttaaatgaagctgcttggacaagtgcccacagccagttggttccctgtaatgtttgtgggcgtaccttcctgccagacagactgattgttcaccaacgatcttgtaaacccaaagccgccaagtaaagcccttttctctctact

SEQ ID NO: 75160 - DNA, 743 bp, Homo sapiens
cagctccttccctgaaaactcagaggtgctcagcatgccatgctaaaaggcaaaataaaaagatcttggagacatctcagctttaatgaggactttccaacattccagactgccgtcctgcaatgaagctctgagtcacggtctgtgaggctaagctttaggccctttcaagctaattggaacagaagagagctaattaactataaaccagaatgaagcttttgtctaataagtttttattaggcaaaactcacagtgggaagagcataatcagaaaaacacatgagggcaggatattctcatcttttcaaattctgcatgtgtatctattagccaacaatgatacggcgtccaccagcagttgtttgctacatttgtggtcgtgaatatggaacaaaatctattagcattcatgagccacaatgtctgaaaaaatggcataatgaaaacaacttgttgcctaaagagttaaggagaccagtacctaaaaaaccagaagtcaggaccattactgacaaataagaaaaacagttctgaaatgcctgtccaaagaattatcttctgatgctgagacataaagacactatgtcctggcaacactgtgcatgagagggacctatgggaatttgctgtattctccaaaagtttctttcatacatcatcaaaccctttgaatgtaaaataaataataaaatacttaaaaaataaaaatgaataaaacttaaaaaaatatgaaacttaaa

SEQ ID NO: 75161 - DNA, 866 bp, Homo sapiens
ggaagtccgaaatcaaggtaccagcaggatttttatgaacttgtgaggaatgctctacttccaagatgtgtggaatggtggaagacaaacattcaggatcttggctagagaaaacctgtgggaggaagatatttcagctaagacataaaaggtgtgaaagcactagccaagaggaaacatgtggaggaagggaatggttagagaaaaagacattcggatcaatggcagcatgtatgaaggtcctgagtggtcctagttcacctcctcagctgtgctgatgtcatgaaaaccagccttgacctcacaaactaccccttgatgatgctgaccgctggactactaatatccaactgcctgtgtcatttcttcatctttccttggtgccaaccatgcctgcatatcagggcagcattctatgatcccatggctctcacatcgacagaccacaacactaagccaacaatgatacggcgtccaccagcagttgtttgctacatttgtggtcgtgaatatggaacaaaatctattagcattcatgagccacaatgtctgaaaaaatggcataatgaaaacaacttgttgcctaaagagttaaggagaccagtacctaaaaaaccagaagtcaggaccattactgacaaataagaaaaacagttctgaaatgcctgtccaaagaattatcttctgatgctgagacataaagacactatgtcctggcaacactgtgcatgagagggacctatgggaatttgctgtattctccaaaagtttctttcatacatcatcaaaccctttgaatgtaaaataaataataaaatacttaaaaaataaaaatgaataaaacttaaaaaaatatgaaacttaaa

SEQ ID NO: 75162 - DNA, 796 bp, Homo sapiens
atcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgactcctattctagcctttccccagaaacagagagtgttaatcctggtgaaaatataaagacagacactcagaaaaagagacctgggactgtgatactatcaaaactgtcaagtagaagaattatatcggaaagccagcttagcccccctgtgatcccggcccgcaggcctggattccgggtatgctatatctgtggccgagaatttgggtcccagtcaattgccattcatgaaccccagtgcttgcagaagtggcatattgaaaacagcaagttgcccaagcatttgaggaggccagaaccctccaaaccacagtctctcagcagcagtgggtcctacagtcttcaggcaactaacgaggctgcatttcagagtgcccaggctcagctgctgccctgtgaatcctgtggccgcacattcttgccagatcatcttcttgttcatcacagaagctgcaagccaaagggtgagggtcccag

SEQ ID NO: 75163 - DNA, 1044 bp, Homo sapiens
gatcaaacccatcttcgaaacaccactccaccatgctggatatttttccatcaaaatttcaaaaaaaacataacgttgggggaaagagggaatgccttaggctttagtgtactggtcctgtctttatcttagttcattccatttttctcccaacaaacaacactcaattggagtttctttactcttatgtgttaggctgagttcagtagagactggaacggtcaaggcttcagactgcaatgaacatccagctgtgttcatgtgacccttagctcaatgtcaccagttaacggcattgtgaatactgtgaagtcttcggggctgttgcagtgcaacactattaacctttacgctggttaaagagccaggttgccaggcaaaacctggacctccaattaagtatagtatttctctgaatcttaggatctttaataaatttatatttggtttacctagaaaatatatttgtctgtgtgtgtgtatatatatacatatgtgtatatatatatattttttgagacagggtctcgctttgccacccaggctggaatgcagtgcagtgacatgctcatggctcactgcagctttgaccttctgggttcaaacaatcctgacacctcagccaccctagtagctgtgactacagaaaaatattttttaaatgaaatgaagtcccaaaaaagtcacaattcaatagtcactaagtatttaacaactaccattttcaaaattgagtgccatctcagtgaccagctatgggacacatgctcactgaaccccagaggcacaggtgaggcttgccaggcagatgactcgacatttagaagtgtctgatttgttttataagaactctatgggaaattaagcaacaggaaaaaaaaaggaggaagaataattgaaactaaaagcccaaggcgaggttacgtcagtcttcagtttaaaataccttgttgctagaatatactgattatgaagcttgtggtgtctcgactagttaagactgaacttgattaaaacttttctctggacacacaaacagaaagg

SEQ ID NO: 75164 - DNA, 489 bp, Homo sapiens
ggaggaacagaaaggacatttagtcagaactaaggggctagataaactgtattgcatggggtagtctcaaataacaaaaaatttctttgagttctaggtcactctgagcattcccaagaaatccacagaagtacaagttcagtttataattatgagaacacagaatttaacttgtacaaaaagatgtagtttttacaatgttttaatttgtactaaatgtttgagggatgcaactatgatgtaaattgaggaaagattatactttatttggtttataaacttaccaaaatttattcccaattttggaatattatacccacccaaggcaacaacattttgtgatatttgagtcaccaagacaacacctctgtattgatttgcaactgtaattgtcacatgaagatatatcatttttattaacatagtgtattattaatgattaaatggtaagtggtgtagcattttaaaatattttgaatttgctaccct

SEQ ID NO: 75165 - DNA, 718 bp, Homo sapiens
gcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggaccccgaggacgaggaggacgaggagccggcgctggaggagctggaacagcgcgaggtgctggtgctggggctggatggcgcaggcaagagcacgttcctgcgcgtgttgtcggggaagccaccgctggaaggccacatccccacctggggcttcaactccgtgcgtctgcccaccaaggactttgaggtggacctgctagaaattgggggcagccagaacctgcgcttctactggaaggagtttgtgagcgaggtggatgtgctggtgtttgtggtggactcggctgaccgactgcggctgccctgggcccgacaggagctgcacaagctgctggacaaggaccctgacctgcctgtcgtcgtggtggccaacaagcagatgttaaaatgaaaacagcgacactgaacaatttcccgagggtgctgaggccccagcctcctgttcgtccttgatttctccttccttcccatcccccgtgcaagtcatcagcagggcctgtcatctcgtctgttctctttacatctcgtctctttaatgtaggtc

SEQ ID NO: 75166 - DNA, 448 bp, Homo sapiens
acaattggatagaaacatgcatgaaattgagataaaacatttcaacagactggacagactctgaacactgttgaagagaacattgataaattggaacctggtgctgaggcattttcccagaatgcaatgtacagagacaaagataaaacagggagaacatggaagacaccttgagatgctccaacaatcatccaattggagttgcagaagaaacagaaaaaatggtgaagaagttggatttgttgagagtttgcagacctggagagaaatgtgaggtctcagatctggagtgcattctggaatagcaagcaagataaatataaataaatgaacccgtagacacgttagaacctctaggtactttagacctagtacctacaaaataagggcagccagatcgttctcagacttcttaacaacaacaggtggcagagaccatggcaaaatc

SEQ ID NO: 75167 - DNA, 365 bp, Homo sapiens
tgtcataggctgacctgttctgaactggtaacattcccagagtttacttatctccagaagtacacaatgatttaaaaagatgttttaggccaggcacggtggctcacacctgtaatctcagcagtttgggaggccaaggtgggtggatcacgagttcaggagatcgagaccatcttggctaacacggtgaaaccccatctctactaaaaatacaaaaaattagccaggtgtggtggcgggcgcctgtagtcccagctactcaggaggctgacgcaggagaatggcgtgaacccgggaggcagagcttgcagtgagctgagatcgcactactgcagtccggcctgggcgacagagcgagattccgt

SEQ ID NO: 75168 - DNA, 795 bp, Homo sapiens
ggaaaaggaatattcactgggatcaggtgatacactggggatcgagaacaaccggggaaccgtaatgagaggggtatctcgtaatacaacagtggaaaaagtaaaatctactgagcgatggatgtgcacagaccatctgctcccatctactaagcagagtgaggcaggaggaatgaggcccgaaatacagggccagtcggggaaacagtaggtgaggcccatgtctataaatattcagaattttttaattaaggtagttcttcgcaaaccatatgtttagtgagatgcaaatcaatttaaaataactttgaatatatcagatatttgacatgatacgtaattcaagaagtctgaaatatattctaaagctagtcttgactatcagcttgttcctgttggaaaaaagaacgaggaagaaaggtgccagacaatgacagagaactaaaagaaatttattggatcaggaaagcaaaactattaaaaagctttatccaaaatgtatccctctggggccaggcatcatggctgaggcccgtaatcccaacactttgggaagctgaggtgttaggattgcttgagcccaggagttcaagaccagcctaggcaacatagcaaggcctggtctctactaaaaatttaaaattagccaggagcaatggcatgcatctatagtcccagctactcaggaggctgaagtgggaaaattgcttgagtacaagaggtcaaggctacagcgagctatgatctcaccactgcactccagcctgagtaacagagcaaaatcctgtctcttta

SEQ ID NO: 75169 - DNA, 375 bp, Homo sapiens
ctcctccacctacctcccactaggcagctctaaattgttaaccactgttagcctaaccattgctaatattaagtcacattaaaataaatgaaacaaccattgcatgcacagcccagagcccggcatgtagctggctctaccacatctaaatccaatcattcattcctatgacagcaaatcccagacactgcagacgtccactaacagcaccctactgtacttcgattcccaaagcaacaaaggctgtcaatgttcttcgagttggggtataaatagggtgagacaattttcagtgctatgtgggaagaagcaacacaatattctcagcctaaaaatagttggatttgtcacagcagtgttgttttgttttattgt

SEQ ID NO: 75170 - DNA, 303 bp, Homo sapiens
agtaagacacagggggcatttttatttattaagataggggaattctgaagttgtttatagggcaacggatatcgcagagagaagacagaatgtggatatcaaaagaagcaagccgggctgggcatggtggctcatgcctgtaatcccagcactttgggaggccgaggcgggtggatcacctgaggtcaagagttcaagaccagcctggccaaaatggcgaaacaccgtctctactaaaaatacaaaaattagctgggcatgttggcgggtgcgtgtaatcccagctgctcgggagtctgaggc

SEQ ID NO: 75171 - DNA, 1430 bp, Homo sapiens
aggtgtcagaaaattaacataagatgaaaaatgattgttaactacctgtttgaaattagtgtatatattttagtgggcctggtcttcatggttttgtaattttttcaaaaaatgatcatggcatgaacaaggctattaatctgaactaatgaattaggagtctacttgccacctgtaaatactgtggaagttttatttattcatttaacattcagggattccacatgaccacctgcaaataatgagaataaagatatgaacaaaatagatgtggttcccgcccttctgaaggttaacacctatctagttagggagacagacattaacaatcacacatatattattaaaactgagataagtgctatgatgaaaaaggcgcgggcagaagagcacagtggtggaaaatgccagtaaggagagtcaagctttatacttgggaacaaaacacaaattttccattttggaaaaaaagcctgagtcgaagtgtgctgactgggtaaattaaggagaggaactctggaacctgggtgcctcagggaaatgtggtggggaccgggcatgagagctggcccgtgaggctgggccaggaaaagaagctggtgctcaggtaccctgagccagggttgcccaaaacaaccaagattctacaactgagtgtggcccaaaaaatcagcaaaataggtctgagatttagaaacagtgagttcaatcccttaacagagagagactgcatctgttgaaatgatatttgattgtgaataacaaaaacgttgccatatagtgggtgaagcaagaagtgggttttttttttttactgacaccacagctctacagtgatgttttatttaaacttatgctccttctgtttctccatgcttcatgggtgactttgttccttttgcctgtcgtctcactgttttgggatggcaactccagtatcatttctttattataggtaggacaaagaggaatgacaaaaggcatgtaaccacctgaatttgcccctatcaaagagctctccaggaagcaccaccaaggaattttcactgacatttcccaggccagaccatgctgctgctaagcaaaatgaggattctgctagtgaggatgaaaggaagaatgtgtaatcagttttcttgaagtataatacatgtacaataaactgaacctattggaaatatacatttggatgagttttgacagatgtatataccacagtcaagatacagaacattcccatcactccaagagattctttgtgtccctttgtggtcaatccctcctacacgaggcccctaggtaaccgctgatctgttttccatcacaatagattagtctgcatattctagcatctttaataaatgcagtcatacagtatgtatggagcatgggggtaggcctaggtcacaagactgaaagacacgacttag

SEQ ID NO: 75172 - DNA, 1484 bp, Homo sapiens
aggtgtcagaaaattaacataagatgaaaaatgattgttaactacctgtttgaaattagtgtatatattttagtgggcctggtcttcatggttttgtaattttttcaaaaaatgatcatggcatgaacaaggctattaatctgaactaatgaattaggagtctacttgccacctgtaaatactgtggaagttttatttattcatttaacattcagggattccacatgaccacctgcaaataatgagaataaagatatgaacaaaatagatgtggttcccgcccttctgaaggttaacacctatctagttagggagacagacattaacaatcacacatatattattaaaactgagataagtgctatgatgaaaaaggcgcgggcagaagagcacagtggtggaaaatgccagtaaggagagtcaagctttatacttgggaacaaaacacaaattttccattttggaaaaaaagcctgagtcgaagtgtgctgactgggtaaattaaggagagaaaagagagtctacctgctttaggacagcatggagcttcacagtgactttgtgggaactctggaacctgggtgcctcagggaaatgtggtggggaccgggcatgagagctggcccgtgaggctgggccaggaaaagaagctggtgctcaggtaccctgagccagggttgcccaaaacaaccaagattctacaactgagtgtggcccaaaaaatcagcaaaataggtctgagatttagaaacagtgagttcaatcccttaacagagagagactgcatctgttgaaatgatatttgattgtgaataacaaaaacgttgccatatagtgggtgaagcaagaagtgggttttttttttttactgacaccacagctctacagtgatgttttatttaaacttatgctccttctgtttctccatgcttcatgggtgactttgttccttttgcctgtcgtctcactgttttgggatggcaactccagtatcatttctttattataggtaggacaaagaggaatgacaaaaggcatgtaaccacctgaatttgcccctatcaaagagctctccaggaagcaccaccaaggaattttcactgacatttcccaggccagaccatgctgctgctaagcaaaatgaggattctgctagtgaggatgaaaggaagaatgtgtaatcagttttcttgaagtataatacatgtacaataaactgaacctattggaaatatacatttggatgagttttgacagatgtatataccacagtcaagatacagaacattcccatcactccaagagattctttgtgtccctttgtggtcaatccctcctacacgaggcccctaggtaaccgctgatctgttttccatcacaatagattagtctgcatattctagcatctttaataaatgcagtcatacagtatgtatggagcatgggggtaggcctaggtcacaagactgaaagacacgacttag

SEQ ID NO: 75173 - DNA, 888 bp, Homo sapiens
tgaagtcagttcgagaccagcttggccaacatagtgaaaccccgtctctcctaaaaatactgtagtcccagctacgggaagctgaggcaggagaattgcttaagcccaggaggtggaggttgcaaggagccgagattgcgccactgcacaccagcctggctgacagagattccacctcaacaacaacaacgacaacaaaaagcagcggggaaaataatacaacacaaagctgctgtggtctgaagggcttaaaacagtacctggtgcatagttagtgcaagcttactgagtgttgagtgttattactgtcaatgataataatagaatgcctttgaacccttctcaggagaagcagcctttttatttcctcatgttggcccctgcatctttgctagagtgatcaattagacacatatactttctgaaattctgagggcacccagtgggatgatctttaaggtatacttccagccagaatgttgggggcggtgtgtgtgtgtgtgtgtgtgtgtgtgtgtgtttctggctaatagtatacactggttaactgagaatagcccattccttttagtttcgttctcctacagttgaacattgattagaaatgcacaaatcctgtcccttgccttagcggagttattagtattcctttctgaggaggccataaggtattatcggcaggcaccataggtaggctgtgagaagggcgagtcagttctgcctcttcccctggcttccacatctgtaaaatgggggcaataacacttagagggcgtgggggctttccatcctcacaaggagatctcaggtgagatgatggctccaagataactttttaaactgtaacatgccggtcacccaaaatggcatatcctccttaccacagag

SEQ ID NO: 75174 - DNA, 313 bp, Homo sapiens
atctaatacaaagctatactacccacacttgtgtctaccctttcatttaaaacacaattaactggccaggcatggtagctcatgcctgtaattccagtacttggggaggctgaggcaggagaatggcttcagaccaggagtttgagaccagcctgggcaacaatgcaaggccctgtctctattaataaacaaaaacacggctaggcacggtggctcacgcctgtaatgccagcactttgggaggccgaggcaggtggatcacgaggtcaagagatcgagaccatcctggccaacatggtgaaaccccatctct

SEQ ID NO: 75175 - DNA, 405 bp, Homo sapiens
aggtagctggaagtgccaaggagttagcacctgggagcagcctttaaacaatactgtgggatttggtggacaaataccccagcgtccttgcccatcagcaggaaaactccaaggcgcatgttctatgctggcttttgagtcccccagtggaattcagctccagttgcccacagtagtgggcaactgcttgatacccaccttttgtttgttgctttcccttcccaaatttacttccccactctcctgctggtcctttcttggattacctcccaagtcgatgccttgcacttgcatccttgtctcagggtttgcttctgggaaaacccaactatgatactgagtaccccacagcaggcagcgctaagacctgtgctgccaccctagaattcagagtcttcagtccca

SEQ ID NO: 75176 - DNA, 511 bp, Homo sapiens
acggcccgggcgcggtacccatgcggccagtaggtgtcgctgttcccctgccggcgggagccaggagccccgcgcgggcccccagcgccactcagccttccgctcccggcaggttcgcagacccaccggagctcccgagagagggccgctctacccgcccccgccccgggactgtgcccgtgctcacctggctaccaccgtagcgacactgccggcctaaggaagtaccttcggggagagaaaggagagacgggtctgttggggcgaaacatgggccccgacggaagcggctccgagccggcttctctcgtggctcccaactctccctcctttctcttcacgtgccatgggcggcggtggggcactgagggcctcctggtaaaatccgaagaggggagattcaaccggggttccatatgggctttacgaataaacaagaggttgaaaatcccagcttcgtgggagctagctacagaaagagtggattggtttcaatattcttgcctcaaaa

SEQ ID NO: 75177 - DNA, 395 bp, Homo sapiens
aaacatttaggttttccttctttgggtcttcattgctttatgagggctcctgtgtcacataaaatttatattaagtaaatctgtatgcttttctcttgttaatctgttttatgtcaatttaattctctgtcccagctagagaccctaagagagtggaggtaaagttttgccttccctactttctcttatctgacatgatcaggagtggattattttatttcaactttaaaaaatacattaattttccatctgtcaaagtgtggccagggtcttttctttgaggatggagcctgtgattagattcctcatcttctttcttacataaacctcaccagttatgtatcacccgcaatttccagtttgcttccttaaagtgaaacagttaatggcatgtt

SEQ ID NO: 75178 - DNA, 522 bp, Homo sapiens
caggagactgagtggttggagccgtccgggagcacagaggttgggagtctattgtcatagcagtcaaagccgggagtcccctgacatatgaggtccccaaggtgtctgctcaagcacccagtgggcagggccctcgtgtgactctgcaggtccatgagtggggctctgcttagcctagacccccaggtctcagttggcttgggacttcttgagagatacatccctacacctctgggaaaaatcaaaattagcttggcacggtggctcacacctagaatcccagcactttgggaggctgaggtgggcagatcgcctgaggagctcaggagtttgagaccagcctgggcaacatggcaaaaccctgtctctacaaaaaatacaaaaattagccaggagtggtggtgtgtgcctgtggtcccagctactagggaggctgaggtgggaggatggcttgagcctgggaggttgaagctgcagtgagccatgactactctgttcactgcacttcagcctgggtaacag

SEQ ID NO: 75179 - DNA, 531 bp, Homo sapiens
ctgtaaattggtgcaagctcatgctaagggaagggacaaaatttgcacttaataagagattgaagtttatatttggtctggacttttaataagtaaaagtgaccagaaatcagtgaaatcatcccaagatttactgtgggatatgtcaaggaaatttgactttgcatagccgaaagagtgtaattggagaaaaattaaattactttaagtttatattattgctccacagaggtttgactacccagtaagctagttacagatatactttaaccactgttgtttttgtaatgtttgtgatcttccataacaaatatttctcatataatgtttttcttaaattgaagtataaaaagaaaattaatcacttaatttgttaacctcttatttacggcttcattggtgttttaaactattcaaagtgctaatcagaatcgctgagataagaaatcaaaggtaatacaatttttcatctgcccttaatagatccagaaagatttaattactggttgcttttgagttacttaaattttg

SEQ ID NO: 75180 - DNA, 3112 bp, Homo sapiens
cacagatctgcaagtgatatttggactgcttacagccttcgctggatcaggaatatcttcacgtaatcactagacagaagctttctcagaacttctttgtgctgtgtgcattcaactcacagatttgaagctttctttagatagagcaggtttgaaacactctttttgtataatctgcaagtggacatttggagggctttaagccctacggtggaaaaggaaatatcttccaataaaaactagacagaagcattctcacaaacatctttgtgatgtttgccttcaactcacagagttgaacataccttatgatagagagttttggaattcccggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcgcgcacctagaacacggcaaggcaggaggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgggcgcgcagcccgccgcgcggcctggactctttttgttcggttgctttggattttacaaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaactaacaaaaaaaattcgagtgttcatttttcgtttcgtttcatccgagccccggcttggttcccggccacgcggaggggtctgcgctcccacacacccagacgggaaggggcttctgccctgctgcagaccgaccgccgcatagcgcggcccctgctccccgcggggccctgccctcctggccacaccaaacgaaacttggaaaagttagagagattgttttttaaccagctgtagaaataagccgttccctgagaaccctccgcctgattccctgcagcttccctctgctccctttccagcccgccgggatgcgggatgccaggggaggccgggagagaaattccccaagtttggggtgaggtgggaaccatgtaaatatgtgagatatgtacacactggcggggagaagaaacattttgtgcttggtttttatttttggttttccgggttacccttccttcctaccctaaaggattttgtacactgactaatccgaaaaagatattttaatatgatttccgaatttctgacccatctctatttattttctggatgtgtttggagcttcccccttctccgtttcttcttctgtttgttaaggtttgaatttaaattttgttattttatttttattattttttgaaacaatgtttcggtgcattctctttgtatctttattgaaaaaaaaataatgtagactgggaagttccctttatatttatgttatagtaaatattttattactc

SEQ ID NO: 75181 - DNA, 2923 bp, Homo sapiens
  misc_feature (2)..(2): n is a, c, g, or t
  misc_feature (4)..(4): n is a, c, g, or t
  misc_feature (24)..(24): n is a, c, g, or t
  misc_feature (26)..(26): n is a, c, g, or t
  misc_feature (28)..(28): n is a, c, g, or t
gnancggcggcggcggcgcgggcngngngcggggcggcatggccaccaccgcgcagtacctgccgcggggccccggtggcggagccgggggcaccgggccgcttatgcacccggacgccgcggcggcggcggcggcggcggccggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcgcgcacctagaacacggcaaggcaggaggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgggcgcgcagcccgccgcgcggcctggactctttttgttcggttgctttggattttacaaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaactaacaaaaaaaattcgagtgttcatttttcgtttcgtttcatccgagccccggcttggttcccggccacgcggaggggtctgcgctcccacacacccagacgggaaggggcttctgccctgctgcagaccgaccgccgcatagcgcggcccctgctccccgcggggccctgccctcctggccacaccaaacgaaacttggaaaagttagagagattgttttttaaccagctgtagaaataagccgttccctgagaaccctccgcctgattccctgcagcttccctctgctccctttccagcccgccgggatgcgggatgccaggggaggccgggagagaaattccccaagtttggggtgaggtgggaaccatgtaaatatgtgagatatgtacacactggcggggagaagaaacattttgtgcttggtttttatttttggttttccgggttacccttccttcctaccctaaaggattttgtacactgactaatccgaaaaagatattttaatatgatttccgaatttctgacccatctctatttattttctggatgtgtttggagcttcccccttctccgtttcttcttctgtttgttaaggtttgaatttaaattttgttattttatttttattattttttgaaacaatgtttcggtgcattctctttgtatctttattgaaaaaaaaataatgtagactgggaagttccctttatatttatgttatagtaaatattttattactc

SEQ ID NO: 75182 - DNA, 1708 bp, Homo sapiens
cacagatctgcaagtgatatttggactgcttacagccttcgctggatcaggaatatcttcacgtaatcactagacagaagctttctcagaacttctttgtgctgtgtgcattcaactcacagatttgaagctttctttagatagagcaggtttgaaacactctttttgtataatctgcaagtggacatttggagggctttaagccctacggtggaaaaggaaatatcttccaataaaaactagacagaagcattctcacaaacatctttgtgatgtttgccttcaactcacagagttgaacataccttatgatagagagttttggaattcccggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcgcgcacctagaacacggcaaggcaggaggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgctaccaaggtaactagcactaaccctgtactgattgtactgaaagctatacgacgtctttggtgacataatacaactcgaggggatgccgacaatcggttagctcactccgagcgccagcgacttgctccaccaccacgcggccagcttgacatactacacagcctaccaacacacacacgtggacaggcgtctagctgaagttacccacgagggccgcgcccccgccgcgcgtatgcaggcgcggcgcgcagcccgcccgtaagcctgactcttttcctttgtctcccct

SEQ ID NO: 75183 - DNA, 318 bp, Homo sapiens
cggcacgagattaaccgagagagacaatacagaaaaggttccagctattcaagtccttctcctcactctcataaaaagaaatatcactgttctctaagtttgtccaaaaatttactggtggaaacctgaattaactgtatttttttcctttaattttccacaccatttttcctgagcagagataatatgaaagcttacctttcaatgccaaaggacattttcttttctttctatgctacagagcaagcatctcctactgtgaacagcagttggaattgtgtgatctgaaagttgaataagaagtgtcatagaataaaa

SEQ ID NO: 75184 - DNA, 341 bp, Homo sapiens
ttttgagacggagtctcgctctgtcgcccagcccggactgcggactgcagtggcacaatctcagctcactgcaagctccgcttcccgggttcacgccattctccagcctcagcctcccgagtagctgggactacaggcgcccgccaccgcgccttgctaattttttgtatttttagtagagacggggtttcaccttgttagccaggatggtctcgatctcctgacctcatgatccacccgcctcggcctcccaaagtgctgggattacaggcgtgagccaccgcacccggcccatttcctctatttttaaatgtgttttatagttttagatcccatgttta

SEQ ID NO: 75185 - DNA, 712 bp, Homo sapiens
aggagatgaaaaaacacattgcaaagatgtttttcagaatgttcctatctagtatttatgtgaagatatttccttttccaccataggcatcaaagtgctccaaatgtccacttgcaacttctactaaaggagggtttcaaaactactcaatcaaaagaatgttttaactctgtgagatgaatgcacacatcataaagaagtatctcagattgtttctttctagattttatgtgaaaatatttccttttctaacttaggctgcaaagtcctccaaatgtccacttgcagattctacaaaaagagtgtttccaaactgctcaatcaaaagaaacattcacctctgtgagatgaacgcacacatcacaaagatgtttctcagagttcttctatctagtttttatgtgaagatatttccttttccaccattgtcctcaaagcactccaaatgtccacttgcagactctacaaaaagagagtttcaaaagtgctcaatcaaatcaaaggtttaactctgtgaggtgaatgctcacgtcacaaagaagtttctcagattgcttctgtctagattttatgtgacaatatttccttgtctaccatagtccgcagagaacacaaaatgtcctcttgcagattctactaaaagagtctttccaaactgttcaaccaaaggaaaggttaaactatgtgagatgaatgctcacatcactaagaa

SEQ ID NO: 75186 - DNA, 269 bp, Homo sapiens
cagaatcacatgtaatgatcttgcaggactaaattatctctttaataactgactttatatgcctttggcagtcagtgctaagcagcctgtgttctcttgcagtgctgtctccatttaagtaacaagtctagtcacgtagacggaaaagaaattgcaatataatagatcatttggatcagaagagtttgtaagagtcactaggaagcagtaagactgaatttaactgtgtgctatctgctgggaagcttcatgttcaaagtaaaatataa

SEQ ID NO: 75187 - DNA, 392 bp, Homo sapiens
gatgcacgacagctgcgtggacagttgtaccatgttcagaacacctcggaggctcatgcagtgaagacaggtaacagatttcaaatcaacactttgctcggttccacacagggaggatacagggctgctgcatttgctaaactaggaagctggaggtcctgctgtgcctgagcccgggggctgagggacacgtggaggctggtctggagacggctcagatgttgaagtcagcatccgaaggcaggggaatggagtctgtctattgaaaagccctccctttgggccatcacccctccccaatgctaacctgcatgaagagtcatgataggatgggtggctgagccactagcctggataaatgcaaagttcaggcctctttctgggagcaaatg

SEQ ID NO: 75188 - DNA, 796 bp, Homo sapiens
agaggaaagatgtcatcaggcttcctgtggctttgtccttcagcagtggggctcggcttgctttcacctgccttaggaagatttctggcttccgagctctgatatggggagaagataagggctgggatctttgagtctgcccctagctgggtatgtgcgtccggtgtgcgggccttggagtttttggtaatgactcacttgtgctctttctgggatctgtctccctcccacatgaccccgtggggtccctgaatgactgttttagagtacccatgtgggttccctgagtcacagcaggggatgtttaataaggaggttagcactgagcttggggacgtgctgtcacaccagcaggacgctgcaggaaggagcaggctacttcctttcttgacgtgcaaataactcgtataggctaatcaacaggcttataagttaaaagggctaccgctcggccccttggggattccatcccctcctctgtaacttggagatgtttgtttctgctgcagactcagagggttgcgatgaagagtggtgggactgagttgagaagcttatcccttcgctgggtgggaggtttctaattgccccgttctttgggggatccttaagtccagcttccaggtgggggcagcgataggaccaagttctcctagtagtctctgggaagccacttgagggaagctgccggtcatcccatgcacccattggtcttctccagcaggccctgtaggtcgtccatgttccatgccttctgggttcttgggggagaaggaagctgttgaaaaaaaaaaaa

SEQ ID NO: 75189 - DNA, 365 bp, Homo sapiens
ggagcccagcagcgtgaatatggctcaatgcagccttgacctcctagcctcaagtggtcctcccacctcagcctcccatggaactgggaccacaggctctcatcaccatacctggctaatttatatattttttttgtagagatagggccttaccatcttacccaggctggtctcgaacctctggctcaagcaatcctcccatcttggcctcccaaagtgctgggattacaggcgtgaaccactatgccacagttgagtttagaatgtttatttaaaatcttgtgacactgaactcaatgactagttctcggaaaacttactttttaatagtgtattgtggtgtaaggcctgaaattaggattcat

SEQ ID NO: 75190 - DNA, 440 bp, Homo sapiens
taaaaaaaattttttttgagatggagtcttactctgtcacccaggccactgtgcctggctaatttttgtattattattttttagtagttctggtcttgaacctctgatctcaagtaatcccctaccctcagcctcccaaagtgctgagccatcgtgcccagccttctgccacattttgtttttttagacagagtttcgctcttgttgcccaggctggagtgcaatggcgtgacctcggttcactgcaacctctgccttccgggttcaggcaattctcctgcctctgcctcctgagtaggtgggattacaggcatgtgccaccacgcctggctaattttgtacttttagtagagatggggttttgccatgttggtcagactggtctcgaactcctgacttcaggtgatccacccacctcggccttccaaagtgctgggatt

SEQ ID NO: 75191 - DNA, 874 bp, Homo sapiens
atgtggatctgcctccagagcaggtacaaggtgagtgagtctatgctgttacctaattagatccccatttctaccctttgtttttacttctctatctactgataggtttttaccctccttcacctcatagggttgcagtgaagagcaagatgaatttttatttatgttgcataaattttaaaagctaaaaaatatatatgtaatgttgggaagtcccagtgtacaaatggctattgtaaatttggaacatgaacttgcttttttccattgtaaaaatgaaatcattataaattgcggtcaagttactaggtcagcccacacagagtttacccagtaatatgcgtaaatgttttgcctttgcatcaacaacaaggaaaaacagtactataaaaaaatgttcctggaagccggatgtatcaaagcacttctgaaatagctatatagcctatagacatgaccagttggtttctgagtctgttgacattggccaaaggagaagctcagtgtagaacatgtttggagtctccttttgcagaaatacattggaggctggagtggggaaccaatttttcagaaaggtggtgaagtagttacatagccactcttttaaagacagtcaaaagatagaaactaaggccaggttcaagcgattctcctacctcagcctctcaagtagctgggattacaggcacccaccaccatgcctggctaatttttgtatttttggaagagacggggtttcaccatgttctccaggctggtctcaaactcctgaactcaggtgatccaaatgaaaaaagatctcaaagtgctgggattacaggcgtgacctaccgcgcccggcccattttgagtttaaatcaaaggagacaga

SEQ ID NO: 75192 - DNA, 844 bp, Homo sapiens
cgctcagtcctgcgtccgggccccgaggcacagccagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaaaaactggcctcgttggcctca

SEQ ID NO: 75193 - DNA, 593 bp, Homo sapiens
ccagcttacacagctacacgtagtggaatgagatagatatacttgtccgtctattctgtccattgattctcagcctctggcatcctacgcacgtgaggagctttgctacgtcatgattggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaaaaactggcctcgttggcctca

SEQ ID NO: 75194 - DNA, 769 bp, Homo sapiens
cgctcagtcctgcgtccgggccccgaggcacagccagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtggaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaaaaactggcctcgttggcctca

SEQ ID NO: 75195 - DNA, 286 bp, Homo sapiens
cttggactcctcctagagcgtgccgcctactacctactatacgagctgctgagaagacgacatgaagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaaaaactggcctcgttggcctca

SEQ ID NO: 75196 - DNA, 621 bp, Homo sapiens
ctaccaaattttatcccacctcttggtttattctccacagttcttcgaattgctcccaaagacctgttttaggtgacatctttaattttctgttttgtctgggacaagtttagtgggtaaaaacaaaaacaaataggaaaccgtcttgatggccactgctgagaagccatgcacttattcacgtgtgtgttcatgtcctctcagtcgtcagttgtgcatccgttgctgcagctcgttcctcacctgcatgagagaagaatgaagagattcagagtggacgtatgtaatacaaactgcatgctggctttgccattccgtgtggggcagccctttctgttaattcccagctgtggtagttcatcaaatgctgctcttcaggataagcccacactaatacccagttagccaatgtaagagcatctgtttgcagactagaagagaattgttcaagccgcccttccatggccccctgcaatattgtgtcccttctagctgaagctgtggacattgaggaaagctggaattatactgttttccaaaagccatggcttttggtgagaaaatctattcttggtttaagaaaggacactgcttttgtccagtccttaggtaggtatgata

SEQ ID NO: 75197 - DNA, 763 bp, Homo sapiens
cgctcagtcctgcgtccgggccccgaggcacagccagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcagtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaaaaactggcctcgttggcctca

SEQ ID NO: 75198 - DNA, 683 bp, Homo sapiens
gaataaaaattgagtcaacttcattttctgctcttcttagtagtgaaacgcctcctgatgatttctcatccttaacttttctttgctattatgaaggggctgacatcaaataagtgattagcaattttgtagagctggggaaaattactactgaggatatttcaaggtccttgtgataggctgttttctgaagataggtcttcactttgaaacatttcctagcaaagccagtgctcctgcatgccaagttagtatgacaatgtatttcttattgcattgtcgttactgcttagcattaaaatacaaacgtcatggcaggacacattatataatagaactctaatcagattctcttttcctttatgaaacacatctcacttatgatatattctccaaagtaattatgttttttcctgtgacttgtgaaaatctgaaaagatgaaaatttctcccatgagcaattggattatgctttgctaaatgaaacatttaataatcaaactgttctttctgtacatttttagaaaaattggattacaattagtgaaaacaagagagagaaaaaaaggccaaactgcaggcattcagcatgaccatgtgctcaggtttctccctgagactttagctctgtaaataatgttttttgtttttgttgttggagacagtctcactctgtcatctag

SEQ ID NO: 75199 - DNA, 656 bp, Homo sapiens
actgcaaactgcctcccgggttcagatgaccctacctcagcctcttgagtagctgtgagtacaggtgcatgacaccatgcctggttaatatttgtattttctgcagagacggttcgccatgtctccatttgtctacaaatctcaaattcttgggctaaagcaatccgtccgcctcgacttcccaaattgctgggattacaggagtgagctactgcacctggccaacattttctagtctcatagggcatgtttaaatctatggcataaacaaattggtttcgtgaaaattactatatagtacattaagttttccctcatcatttaaatagatttttgtgtctattttcctttaaaattttaatgtacttgatctagcttgatctagattattctgtaatagaagtagttgtaaatctctaaaagtaagtcttttgatttctgtagaccatggattttttaaccttggcactactgacattttgggcagatagttctttgttgagtggctctcctgtgcattgtgggatgtttagcaacatccctgacctctaccaaaatatgcaggtagcactgcagagccccagcgcatgtccccactatctcttcttgctgggatggcatcaactaaaaatgtccccagtactgccatatgtttg

SEQ ID NO: 75200 - DNA, 669 bp, Homo sapiens
ggcacgagcccagaaacaaagacttcacggacaaagtcccttggaaccagagtaagtgtcacttgtcttttctgtcttatctgttactgtggagggcagtgttgttcaaagacatgcatgcagctaggggctcctcaaaggtagggggaattctttgagtaggctgggcaaatgtctaagtagcccatggatgcatctccaaggcaattaatactgtagcaatactgagaatggtggatttataaagctgggtgctcagatgaaatataggcttttttgctaaaaaggaagcttacttgaaggattggcttttggttactgattaagaaagtcagtcagtactaagggacaaaaggtgttttctgtggaaacctattcaataagaaattacttggcggggcgcagtggctcacggctgtaatcccagcactttgggagaccgaggcaggtggatcatgaggtcaagagatggagacaatcctggccatatggtgaaaccctgtctctactaaaaataaaaattagccgggcatggtggcgcatgcctgtagtcccagctactcaagaggctgaggcaggagaatcactcgaatccgggaggtggaggttgcagtgagctgagattgcaccactacactccagcctggcgacagagcaagagtctgtctg

SEQ ID NO: 75201 - DNA, 554 bp, Homo sapiens
gacgggagtgcaaggcaaataaggaaaaggattagaaataataataataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcatt

SEQ ID NO: 75202 - DNA, 2667 bp, Homo sapiens
ggcacgagcccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaataataataataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcatt

SEQ ID NO: 75203 - DNA, 398 bp, Homo sapiens
atttattttaataactacccagatattttaacatccttttcatactgttcttagtttcttaaagacaaacttgtagcactgcattttgtgttttaaaaaatatagatgtaatgtatatggcaactatagcaccaaaggatagacgggaggtaagcagaactttagtgttgcaagatttatatatgtaaaaccaaggttaattcgcaaatagttttcattgtgataaattaaatacacatattatagtccctatagtaatcattataagaagaatgcaaagaaatgtagctttaaaaagacaacagaattaaaatggtaaaataaacatttaacgtaaaagaaatcaggaaaagaaggactgaggaacaagcaatatatgagaaaaatagaaaacaaac

SEQ ID NO: 75204 - DNA, 483 bp, Homo sapiens
gaatctcactcttctctaatacgttattagaggggctcctcaaaagcaatcctgttcatattcttcatacttttacaaacttcttaacctatttctccattatcacctcctgccagttcccacccctgtggtccagacttgtagaatcactgccagttcctcaatgctagttcccatgcctttgcacattccatttcctctgcctagagtaccctaagcagactgctactctttcagatgctgttcaagctttcccttcccttagaaagccctctgaaccatgtactgtgagttagagacctctcatctgtgatgcctgcctccttccccactttcttcctttcccaccccaggactttaagctctttgagagcaggagggggagaatgggttttatttgaagatcttcagaaccaagacctagtgtatatagtaggacctcaatatttattgaaccaaacattacagaaaatttggaaaatg

SEQ ID NO: 75205 - DNA, 2364 bp, Homo sapiens
atgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcgggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtca

SEQ ID NO: 75206 - DNA, 1836 bp, Homo sapiens
ggtggctcatgcctgtagtcctagcactttgggaggctgaggcgggtggaacacctgacgtcaggagttcgagaccagcctagccaacatggtgaactaccatctctactaaaaatagaaacaaatttagccaggcatggtggtgcacgcctgtagtcccagctacttgggaggctgaggcaggagaattgcttgaacccaggagacatgggttgcagtgagccgagatgtcaccactgccctccagcctgggtgacagagcgagactccatttcaaaaaaaaaaaaaaaaaatagttagagttaggtaatttctggttaagtaaccatagtgtgtggaagggtgtgcatgaatgttataaatgctgctagggtggaggagtatgcagagaaaatctgccaaggattgtgtgggtttggggttttaagctgtttttttgttttgatgagcactttgtgccaaaaagttattcctctgttctcctcaacttactggcatgaagagttgagagttgactcttctcaaggtggcctcctcatagggcgtctcgctgtgggtgtggaaagaggcaagggctgccagttgcagtctgtttggtgcatgggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtca

SEQ ID NO: 75207 - DNA, 1673 bp, Homo sapiens
atgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcgggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggatttgggcaaaaaaagaatctctctttaaactaaatttcctaggactgggggaagtatt

SEQ ID NO: 75208 - DNA, 721 bp, Homo sapiens
  misc_feature (280)..(280): n is a, c, g, or t
  misc_feature (283)..(283): n is a, c, g, or t
  misc_feature (368)..(368): n is a, c, g, or t
ccagcctgggcaacgagagtgaaactctgtcgcaaaaaaaataaataataaaataaagaccctaggagtcttccatcttaaacctagccctacaggtgaccgaatgcagctggagaataactgcttgttaagaggcagcaaaaccttgggttttgttgggaacatcatctctcactactttgatctcttggccatatgacagactaatcattagtgtcgcatttattcttccagtggtcagatggggtgctcacatgctgcaggttccttacatgtgctngtntccttccctaaactgaaggtgcctttgaaggcagtctttttctacatccatcaagttctctggggaagagcacttcttagctatnccatcaacactcttgccagtctaatctcaccatcagtttcccgtggcctgccctttgtctgaaactttgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagtaagtgtgtcttattttctgtcctgttcatcattaatttttataaaaccccatcc

SEQ ID NO: 75209 - DNA, 245 bp, Homo sapiens
caggacctttcgagtggcgggcacttactggcatgaagagttgagagttgactcttctcaaggtggcctcctcatagggcgtctcgctgtgggtgtggaaagaggcaagggctgccagttgcagtctgtttggtgcatgaagtactgttcatctcgtttagggaagccctcagcaagtgccttttgagacagctgttacgtttcaaataaaagagtctttctccctaagttgcccgccaatcgaa

SEQ ID NO: 75210 - DNA, 2942 bp, Homo sapiens
atgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcgggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtcatggtgttggggtgatcagaatggaagcccttttcaaaatagactcttagtatttttgtcttattcgcaatgcattgattcagccccagaattatttgccagaaatagactttcttcccctggtgttgggagccaggagggttggaaagctcaggaaccctgagctggttcatctgtttgcatattgggtaggttaatttccctggagcctgagagtctttggccagatttcagctgcgtctgcctggctcttttgctgcagctgtgagattggggtctggttccagcagtctgtcactggtcagcctgagtatcacaccctgagctctggggctgggagtttcttcccacaccctctcccttgtgccttaagttgcgatggctctgagtatacaattaatcggaggtgaggggtgggtgtcacagctaatcccaaattcaaaaattagtccaaggtgctgcaaaatataaatttgatgtcagtagaaagtcgtatcctaaaatgtaaaaactgtaagtgtacagtagttaatgagctcagaacatctgataactgcaatttaaaatgggcaaaaagtt

SEQ ID NO: 75211 - DNA, 1759 bp, Homo sapiens
  misc_feature (280)..(280): n is a, c, g, or t
  misc_feature (283)..(283): n is a, c, g, or t
  misc_feature (368)..(368): n is a, c, g, or t
ccagcctgggcaacgagagtgaaactctgtcgcaaaaaaaataaataataaaataaagaccctaggagtcttccatcttaaacctagccctacaggtgaccgaatgcagctggagaataactgcttgttaagaggcagcaaaaccttgggttttgttgggaacatcatctctcactactttgatctcttggccatatgacagactaatcattagtgtcgcatttattcttccagtggtcagatggggtgctcacatgctgcaggttccttacatgtgctngtntccttccctaaactgaaggtgcctttgaaggcagtctttttctacatccatcaagttctctggggaagagcacttcttagctatnccatcaacactcttgccagtctaatctcaccatcagtttcccgtggcctgccctttgtctgaaactttgaaggttagcaatttggagagctgtcagagtggaagcatgggttggaatggtaatggcattgaatgtcttcacgtgttttacttttttcaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtca

SEQ ID NO: 75212 - DNA, 1672 bp, Homo sapiens
  misc_feature (280)..(280): n is a, c, g, or t
  misc_feature (283)..(283): n is a, c, g, or t
  misc_feature (368)..(368): n is a, c, g, or t
ccagcctgggcaacgagagtgaaactctgtcgcaaaaaaaataaataataaaataaagaccctaggagtcttccatcttaaacctagccctacaggtgaccgaatgcagctggagaataactgcttgttaagaggcagcaaaaccttgggttttgttgggaacatcatctctcactactttgatctcttggccatatgacagactaatcattagtgtcgcatttattcttccagtggtcagatggggtgctcacatgctgcaggttccttacatgtgctngtntccttccctaaactgaaggtgcctttgaaggcagtctttttctacatccatcaagttctctggggaagagcacttcttagctatnccatcaacactcttgccagtctaatctcaccatcagtttcccgtggcctgccctttgtctgaaactttgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtca

SEQ ID NO: 75213 - DNA, 1283 bp, Homo sapiens
ccacaccatatgatagtaggcatacggctcgcacctgtcgctagattgttggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtca

SEQ ID NO: 75214 - DNA, 1135 bp, Homo sapiens
cggacgcgtgggtcgacccacgcgtccggacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaagtttggaccccaatgaccagaagtctctagaggggatgcagaagatggagaaggaggagagtcccacggatgccactcaggaggaggatgtggacgacatggaagggagtggggaagaaggggacctggagggcagcgacagtgaggcggcccagtgggctgaccaggagcagtggttcggcatgcagtgagggggcggcagctccatggccgcagtggcctgccctgctctgagcacttccgtggactgaaggaaccgtaggagcctgctctcagaaggacaatgattcagcatgtgattgcagcaggggtctctgccccctcgctcccaattcctagtcgtgacttcatttctaaaacagagcctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctgacagttgctattttgcagaacagttttcctctttgcttagctagtaacttgcctctgagcctgggctgatctgagaaacaggtgtgacaagagcatgaaccagaggtgcacctggggcagttccctaataaaactggtttgtacagtca

SEQ ID NO: 75215 - DNA, 2068 bp, Homo sapiens
atgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcgggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattagataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaaggtaggcactagcctcccttgggggaaggccactgaggagggtagaggaggcagtgagctgtgtcacaggagttatggaaacacacacacactttgtgtccatggttgaaagcagaataataatagtaatggtagaagagttatttgtgaattcatgacttctaaaaattttttcttaaaatatattaacaacattagagaactgtttcactcataaccatcccacaccactataacatctgtgttcatttgtatagctcatcttctgtccttgcccacacacacatatttttatagggctgtacctagtatatattttatattcttctttttcaaatcaaagtattgtaagtactttcccatgtttctatctactgtagtcattaagaacttgaggtctgaagttttgaatactaccttcaccacctgtgatcttgggcaagttactaacacatttccttgtctatatctagctaccttattagatattaaatgatcgaatgagggttaaatgattatttcatgtaaagctcttagctctgtgcctgctacatatttata

SEQ ID NO: 75216 - DNA, 322 bp, Homo sapiens
aatgagatgggccctcagggttaacaggagccacagcaagggttggcctggtggtttatgttggtctgtggggcaagagctgcccgaatgcccctctggggcacctagccccatacagctgagggttcctagcctgagatggaagctgttttccacccaactggtctttctgtcttatacgtgcggcgagatggcatggatctgtttttatcaaatacacaattaaaaagtcacactattaggaaactctgcagtgtgaacatatgggcttctcccaagacttagaatttttcagagccactcggagtgttgggggtcacgg

SEQ ID NO: 75217 - DNA, 516 bp, Homo sapiens
aaaaatgacattcaaaattcataattttttgtgtactataagttctttattataagcacacattagtgctagattataatgtgtcacctgtttagaatggcattgtgaatttagaattctgatcataaatatgaatttttaaaataataatttatgtcactgccattaatgaaggttatgctctctgtatcaacaaagcttgggcattttcaagtatcacttccaaagagtccttggataattagtaaatgtccttctttgtaaatcatcattggcagcaaaatggagaaaagttaaaactgaaacttcaggtggaccggtagcactgtcgtacaaggtggaccattggctttgttgcacagattggatatatgagaatgttctaaaatgtttaggagtaccattataccacttttgtgatgcccgtgccgtaggttgcctctgcagaattggtttacatttagatgtgatgcagcatcttttttcctccctatatccactcaaaatgtaaataat

SEQ ID NO: 75218 - DNA, 650 bp, Homo sapiens
ctagttataaaatcaaacaaataaatgaagaaaaaaacaggagccaagagttcccaagaaagtaagtaattaggcagaacctatccgctatacatcagataaagattctaaccactagagtttaaaatatttggatttaattcatgaaaaacaatgaaaatcctttcctttcccttagagctacatttattgtgcaatcattgtgcttcagggcttcatttagtttttatgcattgtatttaaattatgtgctacttaaatttgtggcatatgtagtttaaattttgttttgaaaagttaattggtgattattgcaaggactgcagttttctgacccaaaaggtctatttttctctcttcctcctccccaccccaaaaataaaaaataaaaaaagccttcaattttttttagttatcagattgctgagtgttcagggaaactgaacactgtcccacaagacaaattattcctttaaagtattcgagataatctttgctagtgatttgtttagggtcagtcatgtgtcccagttctagccaatttaaggggaagtactgagagttatgggaaagagagatccataatgagaagtgaccctttctttctgcctttgacccctagaatggtgacagccaacttctagtcagga

SEQ ID NO: 75219 - DNA, 572 bp, Homo sapiens
ttttttttggcaataaaaaaattcccaaactaccattttttaacctttatatacttttttcttttgtcacctttttcctgcagtatctgataccgtacttttactataccttttctatatttaggtatgtttagatacacaaatacttaccattgtgttagaattgactataatattcagcacagtaatatgctaacaccatgtagtacatggtttagtcagaggctacaccatatagcctaggcatatagaaggctacacaatctaggtttgtgtaactatactctatggtgtttgcacaatgatgaagtcacctaacaacacatttctcagaacgtatccctgacattaagcatcacatgtctgtatttcagagaggtccctaatatctcagtatacacactcacataacagctgaggaagggaaaagggaactttttagaatacacgaaactagcttaaagactcgacataagccgggtatggtggcacacgcctgtagtgtcagctacttgggagctaaagcaggagaatcacttgaacacgggaggcggaggttgcagtgagccgag

SEQ ID NO: 75220 - DNA, 143 bp, Homo sapiens
tatcatttgtggtgttctatagtgttgctcaccagtgtttctggttgttttcccttctggatacatggctgaatcgtattccccttctcttaatactattgcattgggggttattaaattttggggggatgacccatggggga

SEQ ID NO: 75221 - DNA, 336 bp, Homo sapiens
tggggccaagaaaatatataatatgattagccaataagcaaagtaacttgaattgacacttaacaatcattgtttttatctttgtagtaagttaataacttgatatttctaataattggtcttcttagttgtagatgttggcaaatggttctgggtaaagaattgccagtaaggcaacacattctcagaaaacatctgagcccaagatttctccaagcctcgttaattcattgagcattttaaaaatgccttctgttagccagacactgtgctagattctggtatggaaagaagagcaaaacaaaaattcctgccttagagagctcatattcaggg

SEQ ID NO: 75222 - DNA, 458 bp, Homo sapiens
aacatgtaactaataatgtaattgccactctaaattgtcatgattaaatgagattataccttgccactccaattgtcacgattaaatgaggttaccgtgatttgatgataatttcatgtgtgttaccctaattttctaaaaaggattgcaaacttcctggcgaaatccatgtctaatatttagcacaatgataggtactaagtagataataaacactgattcatttatttcgacacaatgttgtagaaaaaaaggactagactggaaaagaagaaacaaggcttattttttcccctagatagccaccaaaaatctgtgatcttgaaaaagtccctgacctttctaggttttaatgtcctcactgataaaaatagagcaagtctaaatttgtaagatttgtatacgtagcaagtcaagtcatctatgagaactaaataggtgacagtttacatacaggg

SEQ ID NO: 75223 - DNA, 466 bp, Homo sapiens
aaggtagttcaagactgtgaatggtaggattgggggagggaagattaaatcaaagttaggaatttagaattgaaacaatctgtgtctattagttttgtataatgattggattattaatagtgcagaacattagtagctgcttggtcattgctttatacattgaaatacaagaagacagtaaggtaaagatccaaaattagaaaatgaagtgatcttggccaggcacggtggctcacgcctttcatcccagcactttgggaggctgatgcagcagaatcacccaggagtttgagatcagcctgggcaaagtagtgagaccttgtatctactaaaaataaataaatacaaataaaataaattagctgggtgtggtgctgcatgcctgtggtctcagccagttgggaggctgaggtgggagctgtccgggaagtcgaggctgcagtgagcgttgattgtgccacagcat

SEQ ID NO: 75224 - DNA, 258 bp, Homo sapiens
atacccattaaataataacttcccattttctgcctgcccctaaccccttcctaatttctgtttcataaatttgactactgaaagaagcaaatgcctggaggaggaagactgtggttttctgattctatcgctgacttagaaaagccagaagtttggggcctgggatctgattattccccagtaattcacaggtgtaatgtgggtgtggagtccaggccatatggctgatgggaagtggggaatgtctgcatcccacca

SEQ ID NO: 75225 - DNA, 381 bp, Homo sapiens
atataaaagttatgttggctgggtttggtggcttacaccgataattccagcactgtaggaggctgaggcaggaggattgcttgagcctaggagtttgagatcagcctgggcaagatggcaagactatatttctacaataaattttttaaaaaattagttgggtgtgaccatatctctacaaaaaaattttcaaaaattaggcatgtgcttatattcccagctacttgggaggttgagacatgaagataccttgagcctaggagtttgaggtggcagtgagctatgattccaccactgaactccagcctgggtgacgaagtgagaccttgtctcttaaaaaaaagttacactatactgtggtctattaagtgtgcaattgca

SEQ ID NO: 75226 - DNA, 449 bp, Homo sapiens
agctgagatgattgcagagtcataaactcttaagtctatttgccactggacatttgcagagatgatcatatttacttccctcctcccaccactcttcctctcagtttcctttttactttatttttttctccctttcctggtaaaagtattagtatgtttaacatagtgttaggtggcagataggctgggaagagctagtattgtaaaggaacactgatgtgtactggagcctactagctctcaatccattgccccagacttggggagagagagcacattctctatccagagaaataagaatatgcagtttatggttgtcctgtggacattaactgactgtgaaggtaaggtatatccaaaggcagtgatatgcaggtgatagattcaccaggagatgatatgtgacttttcttgtattttaaagctctgcttcttttttagaaaaaaaa

SEQ ID NO: 75227 - DNA, 419 bp, Homo sapiens
ttttggctcctcctgcttgggtttcccagccatcaatccacccatctggcacaggattgactcctggtggaacccaactcagtgatctgtgcagtgtggtgttttccaaactggccaaggtgtctgcagggccctcagaattttccaagcaagaaaagatttggctacttggagaaacttcatccttctggaggcatcacctccagaatctacttgaagtggatgacactgacttccatgaactgttttccttttgctgagggtgatggcttccaactccatccatgtccctgcagaggagatgatctcattcctttttatggctgtatagtattccatggttgtctgttcactctgatgatggttccgtttgctgtgtggaagctcttaagttggattaaattccagtcgtcaatttc

SEQ ID NO: 75228 - DNA, 479 bp, Homo sapiens
caatatagttaattttgttatgtatatattatcacaattaataaaatatcatttgtgtcttaaaaaaagtattacttgtattatctagacattaaaatagaatgagaatacttagtgtttattgaacaaagctaccctgacaactatagtaaaatgaagatgcaaaagagcataagggaagccattcatggggcatgtattggtgaaaagctgtgccctcaaatacttcactccttgcaattcctttttataggcatcacctccagaatctacttgaagtggatgacactgacttccatgaactgttttccttttgctgagggtgatggcttccaactccatccatgtccctgcagaggagatgatctcattcctttttatggctgtatagtattccatggttgtctgttcactctgatgatggttccgtttgctgtgtggaagctcttaagttggattaaattccagtcgtcaatttc

SEQ ID NO: 75229 - DNA, 226 bp, Homo sapiens
gtttatttctcattgatcatctctaatcttcacaagtgctccacaagtgagtttggaggtctgttttgtagctttcttgcatttacagcacatagtttagtagtgacacaaaataactgtttaagtaaatgttagtgctatcatcatcatcatcatcatcatccctgcagtggttcttttagaaaccacttcagaaaaagggagaggaggcactttttattatcag

SEQ ID NO: 75230 - DNA, 350 bp, Homo sapiens
tagcctcgacctcctgggctcaggcagtcctcctacgtcagcgtccacccaagtagctgaaactatgggcacacaccaccatgcctggctaatttttgtattttttagtaaagacgggatttcactgtgttacccaggctggtctcaaactcctgggctcaagcgatctacctacctcagcctcccaaagtgctgggattacaggcatgagccactgcaccaggcctggtacagtactattaattgagggagggaatgacacttccctaagtgtatcttcttgtattattttgacttctggtagcatatttgtgtcttacatatattaaaaaattcaattaggataagaa

SEQ ID NO: 75231 - DNA, 1263 bp, Homo sapiens
tcgagctcggtccccgatgagtaacctggctaattttgtatttttagtagagacggggtttctccatgttggtcaggctggtcttgaacgcctgacctcaggtgatctgcctgcctcggcctcccaaagtgctgggattacaggcatgagccatcacgcccggccaaagttttagaatttaagttattccaaaaaaaattttttttttcaaaaatacagactgcatccaattaaattctatgttaactggtaatgactaggtctaaaatgttaggtatttaccaataaatgacataaaataactcaacaacaaagggatttttttttttaagagatagggtctcactttatcactcaggtttggctgagggcagtggtgtgatcacagctcactgaagcctccaactcctgggctcaagtgatcctcccgcctcagtctaccagagtatattcttgaaagtaaaattacaaatgaaattcagcagtgttaaaaataagcccacttgcagacaattatcatttttcttcctttctttcctcactatctgtacttggcatatttcctacagtggctgtcttaaagaaaaaaaggaatccttcacaaatagtgtagccaaaaaagttggactaatatacaatgctatcagtaaagtattatatataaaatttataagtgctaaagtgtaattttgaaagacacttaagatactccttttttttttgagacagggtctcagccctgtcgcccaggctggagtgcactagcacaacatcagcccactgcactccagcctggtgacagtgagactctgtcacacacacacaaaaagataaagaatgacaaaatctgtgcctacattcagagtgacaagaatattaatgttctgcttgtagaaaagactattggttcagaatatgttaaatgcaataatattttgtataatatatataaattacatatgcataaaaagagtatctatattagaatcttttgagacagggtcttgctctgtcaaccatgagggagtgcagtggcactaccacagctcactgcagccttgacttcccgagctcaagccatcctctcgcctcagcctcccgaatagctgggactgcaggtggtgccaccaaggctggctaagtttttatatttttttatagaaacaagcttttgccacgttgcccaggctggtctcaaacttctcaaagctcaagcaatctggccgccttgaactcccaagtgcttgagttacaggcatgagt

SEQ ID NO: 75232 - DNA, 2105 bp, Homo sapiens
  misc_feature (1)..(5): n is a, c, g, or t
  misc_feature (595)..(595): n is a, c, g, or t
  misc_feature (610)..(610): n is a, c, g, or t
nnnnnttaattaacttttctctttgtgcttgcacacttgctttgctttgctttcaatctatagttattttatgggtggcttggcacctcaaccagatgggaattaagtggaaggcagaagttggcttgcacacacaacctctaaataaatgcaggcctgggaaggatgattcatgctttacctgtattctttcagctgcagtcagtgtttttccaatcttggtaggcaccagcatcacctggaaaattgttaaagcaaaacatgctttgacttgactccagacatactggggcttaaatctctgtatttatttgccaagtggttcaaaatttagtagttgggggaatgggatcaccaaccattatggtttgccaaggaacgaaggatttcctgagctgtgtgctaaagcctgaatacttctgagtaaattgagacatttagttaccctatttagggttgaagatgagggccaaaatagtgcatgcatctgtctgctttccatctttccatcctaattattctaaaaaaccatacaacccccacttttatgggtataaaatagttatgttacttatctatttttatttttgcatantttttagttattgcntggtttattacatataatgagagcaacaatctcataacattggttttagaattaaatgagataaaatatgtaaagcacttaatgtaatgcctgatactaagtgttcaatgaatgttacatattatttctctttaggtccaaaggtatttattttcttcttggcttcctggaatactaatctttggtaaaggaagtttctcactggtctcctaagccggcagtggtctgaggcatgccaccatttctttgagctgtgatgtgttatatcatcttcttccaagacaggccctcttagctagtgtgctaactggactttctctctctgactcaaaggggctgtgcctcagaagctttgtggaggtagaaaggcttatccacacttcccatgataggagagggattctacccaccttctttctggattcttctatggactgtaatgatttcttcctcagtagtgtctattcccagacccagcaactgctttttgaaatttgcttgcagacatcaaccctgcaactctctatctagttctcagcacttcaacttaaggctaatattagaccaagacccacttcctctagaaataaatccttttctcccccatactttcttggtcaaataaggttacagacttatttggcacttacttaagtagttttttttttcatccttaggatggttctcaatttgttgactgatgaaatcataaaacgtaacgtaaccctctaggtagcagaggatgtgctttgtaacatcatccagcactccttgttgcattatcctacagtctcagtaatctgcattgtctcacagatcaagccatttgctcattcagtctgttctgtgccaaacatattgataacacatacactgaaggactgctggcattgcccctccccagaataagcaaacaagtcatctttaaaagcaagttgtttcagccactttgatagaaattaagtcgcatacaaggtcacaaagtacatcagtgaactaactggaaacacaacccaacaaggcccactcccaagcctgagcactttactggatcacgcttccttcctcggtgaaaggcttcccacggcaggaagaaccggagagcaagcctctaaattatacatgactgtttgtctcattttcactccgtggctaattgaagacacaggggagtgctgcttttttggcttcatctctcatcgcatctcatttgtctcacacgtgtcggggagtgcactctgcaggttagctttatgaagggttgaatggaatttggtgagctttgaggagtcccaggattacaagttctttgtcttggttcacaacaagctgtgcagtccccttttgtttgtttcctcatttgccattttaaaataaagtaaatacctaatgctagatgacgagttagtgggtgcagtgcaccagcatggcacatgtatacatatgtaactaacctgcacaatgtgcacatgtaccctaaaacttaaagtataat

SEQ ID NO: 75233 - DNA, 571 bp, Homo sapiens
gtctgatttaaagaatatttatgaaaaaaatccaatctattttcttgagtttctaaagcaatctaatagctagctgagaagacctgttttataagtaagcattgtaattagtatgtaaagtgtatgcaatagtattgctaaaagttctctaaaatagtatgttttcttaaggaggctaaacatctgtcctacaattttagttattctaccaatttgcttagcaaactatttttaccacaaagaatgaattggttcagctctgttaacaatatattatttttcaattaggtccagatacatgagcttttactccccttattgccagtttctaaagatgcaaacaaatatggaatggaatggtacttttttgctattcaaaatataaccaagaggataaaatttgtgttatcattgatgtctccactgatacaatttaaaaagaaaaaaaaaaagctacaagaacaattgtaggaattcagtaggcctaagtaaacaccactattttgtacattgcttgttcaatttattcttaaatttcacaatctggaaagcaatcctaattacacacaaa

SEQ ID NO: 75234 - DNA, 696 bp, Homo sapiens
gggccacaaagtatccagggtgctggggcaccaagtcaggaaatgctctcaaaaggctcgggggagaaatgctgtgtgtctgcaatgtttctgtaaggttgagagattgtttttccaggaaaaagcaacatcatcctcatcccagccctgtgctgttactcccactccacaggcaggcgagtggaaccacaggtgcttcccgtcctggtcacaaagtcagagtggctgggccaagtgtcctgagaagagtcacctcctgggatcccatcagcctggccatagcagaacacccagacaggggcccatccccgaggctcaactcaacgcatgcagccactgtagaaaagtctggaaagtagttcttcaaccgactagacatggtgagcccaaaacccagccatgacactcctaggcatctgccccagaggaatgaaagcatccatcccctgcaaactcatccttacacagcagcgtgactcaagacggccaaaggcggaaacaccccaaacgtccatcagtggacaaacgggcagatgcaatgcactgtctgtaccgtgggatgtcactcagccatatgaaggaaagactccagtggcgaatgagccctggaaccacggtgctgcgtgatcccgtaacacatggccagaacagacacggcccggaacctgaggccgggaggatgcgtgcaggtggcgg

SEQ ID NO: 75235 - DNA, 625 bp, Homo sapiens
gcacgctggggagatggtccctgcgggaagactccgaggcagtctcctgcagctccttccggcgaatccggttcaggaagtaaaaccagccctgtgtagaggcaggcgagtggaaccacaggtgcttcccgtcctggtcacaaagtcagagtggctgggccaagtgtcctgagaagagtcacctcctgggatcccatcagcctggccatagcagaacacccagacaggggcccatccccgaggctcaactcaacgcatgcagccactgtagaaaagtctggaaagtagttcttcaaccgactagacatggtgagcccaaaacccagccatgacactcctaggcatctgccccagaggaatgaaagcatccatcccctgcaaactcatccttacacagcagcgtgactcaagacggccaaaggcggaaacaccccaaacgtccatcagtggacaaacgggcagatgcaatgcactgtctgtaccgtgggatgtcactcagccatatgaaggaaagactccagtggcgaatgagccctggaaccacggtgctgcgtgatcccgtaacacatggccagaacagacacggcccggaacctgaggccgggaggatgcgtgcaggtggcgg

SEQ ID NO: 75236 - DNA, 676 bp, Homo sapiens
gcaacggggaactgaacgctgcatgaagtacatctccaagttgttctttaagaaggcttagggtccctggaagaccctcgcccacacccagcgtggagcgttgttgctcacgtggccacacctctcgggatggccgtgggtctccgtgatgggcaggcgagtggaaccacaggtgcttcccgtcctggtcacaaagtcagagtggctgggccaagtgtcctgagaagagtcacctcctgggatcccatcagcctggccatagcagaacacccagacaggggcccatccccgaggctcaactcaacgcatgcagccactgtagaaaagtctggaaagtagttcttcaaccgactagacatggtgagcccaaaacccagccatgacactcctaggcatctgccccagaggaatgaaagcatccatcccctgcaaactcatccttacacagcagcgtgactcaagacggccaaaggcggaaacaccccaaacgtccatcagtggacaaacgggcagatgcaatgcactgtctgtaccgtgggatgtcactcagccatatgaaggaaagactccagtggcgaatgagccctggaaccacggtgctgcgtgatcccgtaacacatggccagaacagacacggcccggaacctgaggccgggaggatgcgtgcaggtggcgg

SEQ ID NO: 75237 - DNA, 575 bp, Homo sapiens
gaggatggaagttagagaagcagcaagaaaaaggaagaaagggctgattgtgcaggcactgtctgcacagctgccatgtgcccacgtgggatgcgtgcggggcggggcggcgatgcccccggggactgatggtggaagggctggtctgctgcctgctctgtgcgtcgatgccatgtgacagctcccccccatggcccagcctatgtgatctctctgccctgcactgagtctgcactgcattcacggtgccagcatttcagtcagtgcaccacatgtgcctgtctatgggcccggcagccacgtgcagggcgggtggtgaaggaatgaagactgcctcagctcgggggagcctgggcatttatgaaatttacctggcctagattttctcttaggtccgtttcctgttctatgagtagtaaagtttaaattcaggttgagatcatcagtgtggtctaatgaaatatatatgtatatataaaactttattatgccatatgtgcacatctactttcataacattttgtattttatagaacacaaaataaatactactgaattactcaaaaattaaaaaa

SEQ ID NO: 75238 - DNA, 3986 bp, Homo sapiens
atggacttggcaccttattttacttctgagccgctctctgctgtccagaaacttggtggacctgtagtactgcattgttctgctcaacctgtgaccactcgtatctcatggctgcataacggaaaaacattggatggaaacctggaacatattaagattcatcaggggactctgacaattctttctctcaactcctctcttttgggttactaccagtgccttgccaacaatagcatcggtgccattgtgagtggccctgcgacagtatctgtggcagttcttggtgattttggttcatccacaaagcatgttattacagcagaagaaaaaagtgctggtttcattggctgcagggtaccggagagtaaccccaaagctgaggtgcgctataaaatccggggaaaatggctggaacattccacagagaattacttaatccttccatcaggaaatcttcagattttgaatgtatccttagaggacaagggatcatacaaatgtgcagcttataatcctgtcacacatcaattaaaagttgaacctattggccgaaagctccttgtgagtcgtccttcttcagatgatgttcacattcttcaccccacccattcacaggcattagctgttctttctcgtagccctgtaaccttggagtgtgtggtgagtggggtcccggctcctcaagtgtattggctaaaggacgggcaggacattgcaccaggaagcaactggagaaggttgtattctcatcttgccactgatagcgttgacccggcggactccggaaactattcctgcatggcgggaaacaagtctggagatgtagaatatgtgacttacatggttaatgtacttgaacatgcttccatttctaaaggactacaggatcagatagtgtctctgggtgccacagtacactttacctgcgacgttcatgggaacccagcccccaactgtacctggtttcacaatgcacagcctattcatccttctgcacgacatctaactgcaggaaacggactgaaaatcagtggggttactgtggaagatgttgggatgtatcagtgtgtagcagataatgggattggatttatgcactctactggaagacttgaaattgaaaatgacggtggattcaagccagttataattacggcaccagtaagtgcaaaggttgcagacggagactttgttactctgtcctgcaatgccagtgggctgccggttccggtcattcgttggtatgacagccatggattgataaccagccatccatctcaagtcctgagatcgaaatcccgaaaatcacagttatcaagacctgagggcttgaacctggagcctgtgtacttcgtcctgtcccaagctggtgcaagctctctccatattcaggctgtgactcaggaacatgcggggaaatacatctgcgaagctgcaaatgaacatggtaccacacaggcagaagcatctctcatggttgttccttttgaaacaaatacaaaagcagagacagtcacacttcctgatgctgctcagaatgatgacagaagtaagagagatggttcagaaactgggttactgagctcatttccggtgaaggtccatcccagtgcagtggaatcagcaccagagaaaaacgccagcggcatctctgttcctgatgcccccatcatactgagccccccacagacccacacaccagacacgtacaacctggtgtggagggcaggcaaggatggtgggctgcccatcaatgcttactttgtgaagtatcgaaagctggatgatggggttggcatgctgggaagctggcacacggttcgagtcccaggaagtgaaaatgagctccatttagctgagctggagccatctagtctttatgaagtcttgatggtagcaagaagcgcagcaggtgaaggccaacctgccatgattaccttccgaaccagcaaagaaaaaacagcgtcatcaaaaaacacccaggcatcctctccacccgtgggcatccctaagtatcccgttgtttcagaggctgcaaacaacaattttggagtggtacttacagattcctctaggcacagtggagttccagaggcaccagatcggcctaccatctccactgcatcagagacatcagtctatgtcacttggattcctcgggcaaacgggggttctccaatcactgccttcaaagtcgaatataaacggatgaggaccagcaattggctggtggcagctgaagacatccctccttccaaactttcagtggaagttcgtagtttagaaccaggttcaacatacaaatttagggtcattgccatcaaccattatggtgagagttttcggagttcagcatctcgtccttatcaagtggttgggttccccaatcgcttttccagccgtccaataactggacctcacattgcatacacagaggctgtcagcgatactcagatcatgctaaagtggacgtacattccatcaagtaacaataacactcccattcaaggattttatatctattaccgaccaacagatagtgacaatgacagtgattacaagagggatgttgtagaaggttcaaagcagtggcacatgattggccacctgcagccagaaacctcctatgacattaaaatgcaatgcttcaatgaaggaggagaaagtgaatttagcaatgtgatgatctgcgagactaaagtgaaacgtgttcctggagcttctgaatatcctgtcaaagacttgagtacccctccaaattctttgggaagtggaggaaatgtggggcctgcaaccagccctgccagaagcagtgacatgttatatctgatcgttggctgtgtgctgggcgtcatggtcctcattctgatggttttcattgcaatgtgcctgtggaagaatcgccagcagaataccatacaaaaatatgacccaccaggatatctctaccaaggatcagatatgaacgggcagatggtggactacaccactctctcaggagcaagtcagataaatggaaatgttcacggaggcttcctaaccaatggcggtctcagcagtggctattcccaccttcaccataaggtccccaatgcagtcaatggaattgtgaatgggagcctaaatggagggctttactccgggcacagcaactctctaaccaggacacacgtggattttgaacatcctcatcatctagtgaatggtggtggaatgtacacggccgtgcctcagattgaccctctggagtgtgttaactgccgaaattgtcgaaacaacaataggtgtttcaccaaaaccaacagcactttcagcagcagccctcctcctgtggtccctgtggtagcaccttatcctcaggatggtttggaaatgaagcccctcagtcacgtgaaggtgcctgtatgcctgacttccgcagtccctgattgtggccagttgccggaggagagcgtcaaggacaatgtggaaccagtccctactcagcgtacctgctgtcaggacattgtaaatgacgtcagctctgatggctcagaagatccagcagagttcagcagaggagacagctgtgcccattcagaaacagagatcaacattgtaagttggaatgctcttattttgccacctgtccccgagggctgtgctgagaagacaatgtggtctccacctggcattcctttagacagcccgacagaggtccttcagcagccccgggaaacctgaggacatgcaaacaaccagtcatgttccaacttcaagccggtaactgcacacaacaggcctgggagcgaactgtgtgaaggaccttaattcaaatcagagaaaatcattatttatttttttgtagtagtaatgtcatatgaatgtatcttaaaacgtgtgcccttttatattatttatgccttaaatgttttcttccccattccttcctccccctcggtaggaaacaaccttgttttgcatagtattcagtcacctggagggca

SEQ ID NO: 75239 - DNA, 434 bp, Homo sapiens
ccagtactctgatagtttcagcttgcccaatatattcattctcttttgagtaatttctccctaggtgatttttcttcccgttaacagaatcataattaactcagagttcacagctatctctacactctatggaaaataatagcagtaactttattaaagcatgtcttacaagtaggctttaagtgaacattttaaaaatgtttttattttagtctatttgtagtttcgtaggggttttatctgtaagaccttctcagcaagaagattgtcctttttagtgtcttactgtgtgcgtgtgtgcgtgtgtgcgtatgtgcatgtgtgcatgcgtgtgtgcgtatgtgcatgtgtgcgtgcgtgtgtgtgtgtgcgtgtgtgtcttttttgttctcttttaacagaatatgacccaccaggatatctctaccaaggat

SEQ ID NO: 75240 - DNA, 473 bp, Homo sapiens
ccaactggtatcacatgaaattcttccctgactgccaagaaagggaaaatgaatggaggctataacatataatgtattttgagcccactagatttgaagggaagtgactaaacttttcccttcatttatttacctttgtctagtacagaaatacgtaggaaaacatggcagtgaagtttttggaatacagttaaatctaatgcagaactctcattcactcctttgtgaatatgggtcagtgatattcacaatgacgttgctctgggagttggttagaatatactgtgtgcccatttatggttgacatggctcatgtgtatttgtgattatttggctactggtctgtgagtaccttcagcattccttcttcttttctttttctctgacactccttcctgtccagggtggtggaatgtacacggccgtgcctcagattgaccctctggagtgtgttaactgccgaaattgtcgaa

SEQ ID NO: 75241 - DNA, 594 bp, Homo sapiens
tgtagttcaacaaaaaacaacatgtttatatacatttggaaactgcaatgataggaaacatttggaagaaagggattttgccctagaataacacataaggaaagcagagaattagagtatattgttactgaatgttccagagacttctagtgattttaacacttattaagtatagcatgttgatggggagatttgtttctctaaagatcactttgttttattaaatcctaatagaaaatacccttgaaaatcctatctcatttattcctgtaacaaatttattgagcacctacctactatatgccaagaaatgtattagccatcaggcaggagagctgttcaaatggtagatatgatctgtgctcctgtgaaacttctagtggggagagccaaacaataaacaatattcctttttaactctaggttaatgcagaaatgggataaagcccatgttgcttttggggagaggtgagttgtgtctctggaatcacatggcatttcatagggggggaaaaatgccccaaatactaaggagtagctcttagcctatgtccgttcgcctcagcttaagttgttttccctcccactggctgg

SEQ ID NO: 75242 - DNA, 501 bp, Homo sapiens
aattctggcatttgtggatatgaaataaatgccaaattgactaaggtgttgtggatgctgaaacaaagcctaattaaatagtatgaaacactgtaggtaatgtgcagctgttgtgaggttagggaaggcagccttttcagaatttttattaagagaaggaaggattagaattaagcattactaaggactcagattttacgaaaacttgttttttaaaaaatgtacatatgaagcttaaagtgtcttttacagaaaaaaggaatggcatccaaaatgggattgaaatggctttgaacgttttccttgaatgcaacatcagatccttttcgggactgaagaggaagggaggcattgggaaagaagtgaagtggggatcagtgaggcaggacttaggaagctcactggaagagtggaggcacctgtgtctctgcctctgggtctcatcttcaccccagctgagacttgcagtggaaagtatttttgaaaataagctttaattta

SEQ ID NO: 75243 - DNA, 858 bp, Homo sapiens
accagaataaagaatagcaattgattacaaaacattaaataaaataaaaatacatgaattcatactgatataaatgaatatatagactggggagactaagaaggaataatgaaatataaccacttagtaaccatcatactaataactctttctagtgagaatcatcaatgggtattaaaactattatgtaaaggtttaataagaaataaaatatttacataatctgaaagtatctcccaataaggcacttagtaatttaaaaaggaaaaacagtatatttaccattgagaaaactaaaatataccacttttaccaagatataaaagttaacctttccagaaatgttcacagcagcctcattcttaatagtcaaaagtgaaaacaacccaaatgtctattaattgacaaatagatttttaaaatatggtatattgagataatggaatattattcagtcataacaaaaacaatgaagcactgatatatggtataatacagacgaactctggaaaaaaaaaatcacaataagtgaaagaagccacacacaggaggccatgtttgtacaattccatacatacaaaatatccagattagacaaatccatagagagagagaaattaaattagtggttgccagaagatggagatagagagaatagacaggtatggggtttcttttggggctgatggaaatattctggaactagtggtaatagttgcacaatattatgaatatactgaaaaccactaaattgtactgttttaaatgatcaaaattaagaagtttatgttatgacttttatctcaataaaaaaggttttttcacaaaaatttaacttcaccagccatgggagaagaa

SEQ ID NO: 75244 - DNA, 815 bp, Homo sapiens
ggaaaggggctgatctagaagtctatggaatgtattagttctccacggtgactgcctctgtgaatctgccgctaagggtctgagggtgggcttgccatcactgctggtcagcagggtcggggagagctagatacagagcagggaagatggaggacaaactggaagctgctggcccctctgtgtctggccacccctcactgcttctaaccaatgatgaccttcagagtgtaacggctgctgcttcccatgagcctccctggtcttgcacaacctcattttggggcaactctaacctaggaacatacaggaaaaggaggtctgagaaatgtggttcccagcataaccaagttgtcaacagaataatccggtagatgtagtctctgtactcaaagaacaggaaaaaagagcagagaggccaaaagagggtactggggcagttttgctgtgtgatgagtgatgtcatccctcccttcatatctccacctcatcttcaataaaatccacagcccttggccatactgtttaagttggatttatttcttccactttcctcccttcctcctccctccatcccttcctcctcccatcctctccccctctcttccttccctcccttctcccttctagatgtcctgggtctggtctgaacttggcacggggaagaacaaggcctgcaaaggtggtccaaacacatacagtttccactttactgaaaggagacatgggtttccaatgttgagaaatcataatctagccaaccctcttttttatgttaacttcgtctcctttctatgaatgaggcaatgcagaagtac

SEQ ID NO: 75245 - DNA, 1176 bp, Homo sapiens
gtgctgttttgcttttttataaaacatcaaataattattgtttttatttagcaactggtgtgtcatttgtaacatagacctttaaataaaaacttaattaaaacttggtaaggtagcatggaaaatgacaattggttatttccttttttctcttagtttattctttggtactataaatacagtcaagtagccaaggcagcaggcttagcgttattttgacacattgatttttcaaattaatgagtagcgtaagcagttgtaagtcaaatataagtggacttaattctctctatatattaaaatatatataaattgttttctttctatttaaaagacacatttttaattttaggtaaagaatagattgaataaaatgttttttaaaataaatgattatgaatttaataaaaattacatggtttttgtttcataaaactcaagaatttttaaagtatttaatttcaaatgaagttgtaaaacaagattaatggtaataccattgatcttagaaaatacaaatgaacagtgaagaaggacacataacttgtagaacccagcttggaaacagattagccaatttatgaattatagcgtggcataagatttccttgttggaaccagtcattaaagtaaatgaaagtatttctgaatttcattaactgcatttggctttctttcaccacttacccacttcacagctggaaaatccttttaacccgtatttcttatgaaatagtagcattattcaagtactcagtgcttggttaatcctaatgtttgcaccaaataaaatacagcattatgttatgaatctttattctcccctcttcatttagctagaacatttataagttcgagattaagtttcaataagctgatagttggccggacgcagtggctcacacctgtaatcccagcactttgggaggctcaggcgggtggatcgcctgaagtgaggagttcgagaccagcctggccaacatggtgaaaccccatctctactaaaagtacaaaaattagccgggtgtagtgggtgtgcgcctgtagtcccagctacttgggaggctgaggcaaaaaaattgcttgaaccgggaggtggaggttgcagtgggccgaaaccgtacctctgtactctagcctggcaacagagtgagactttatctcaaaaaaaaaaaa

SEQ ID NO: 75246 - DNA, 369 bp, Homo sapiens
gagtagattttaagtactttcactgcaaataaataaatatgtgaggtaaacaaaatgaaacaaagagtactccaaagcctggactaagtagcattggagatcaaaagatgtaaatgattgtttgaagaattaataaagtaggattttgttgatggttgagggagagaggaagcagaagaaaagtcgggaggggatattactttgctttctgtgccattttcatgataaggaacatgaaggaggccaggcacggtggctcacgcctgtaatcccagcactttgggaggctgaggcaggcggatcacctgagctcaggagttcgagaccaccctgagcaacacggtaaaatcccatctccactaaaatacc

SEQ ID NO: 75247 - DNA, 607 bp, Homo sapiens
catgtttgagggaaaaagggtccatagctttgatcagattcttaaagggattgctgaccccaaaaaaggtcacaaatccccaattttgatggattttgtgtcccttcaaaacatatttaatctgtctctccacccccttttccccttgctccaaatgcctgaaaggtttaacatttaaacactacttttttccctaatgtatcccacatttatctttatatgccactttttagtaatttggataaattgtcttttttaagaagttaaatgaaaattcccttcattagttcttcgatggacttggtgatatctgtacgaccacagggtttagaataaagtcgcttgtaaaaagtattattttatgccacatagccatgatctctgaatgtattttttgtgactttctgattgtaaaccattaacatatacgaaacaagacattctgtttagttaagaacgttagctttctgaggtcaaggatctgtttctctgttgttggtaactgctatccaacagtcccggaacataataggtgcggaatgaaaataggtgcagagcaaatgaaaaggccttcagtgtttaaagaaaataaacctaatttttaaaa

SEQ ID NO: 75248 - DNA, 366 bp, Homo sapiens
gttttagatatagatcttattatgtcacccaggctgcagtacagtggtgtgatcatagctcacttgcaacctcaaactcctgggctcaagccatcctcccacttcaatctcccgagtagctaggcatgcaccaccccacctagctaacttttaaaaaaatgtctgtagagacagtgtctcatcatgtctcaaattcctggcctcaagtgatcctcctcctttggcttcccaaagtgctaggattaagggtgtgaatcattggacccagactggtttttttcttaattgaaaatgcaactatatgaaataattataaaactattgttgagcttataaaatataaagatgtgacgtagataactataa

SEQ ID NO: 75249 - DNA, 582 bp, Homo sapiens
gtgtgtactagtgcacataataaactcaaaagcaaagatggctagaaaatgatggttattatgtattggctgacttatttgacactcttaattatttgtcctgtggggtcatggttaagggtgaggtgctcagtcttactgtctgagtttcaatcacggctcagcctctccccagatctgaggtccagagcgagtcacagaaccctgtaaacttcaggctccttatttgaaaaatggccgtgacaaaagtagttccatgtaggatgttaaacgtgttgcttggcacatggttagttattggtaaaggctataaattagtttaaattaaaaaatttattataagtcaatgtatttaaattaatttacagctatttaacaatagctaattagcacagcattataattgcagtaccagagaaaaacaacatgaaggaatacaagtatttattccctacattgctaaaataccaacactgattatcaatattttctatggaaaggtattcagaatgcctaacattttaaaattcagctaaaatattagacatttcaaataaaaagtaaatattagaagcattaagt

SEQ ID NO: 75250 - DNA, 1049 bp, Homo sapiens
ggcgcgcgagagccaccgggggggacctggaggagcagcagcacgcggagggaagcccggagccaggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacc

SEQ ID NO: 75251 - DNA, 683 bp, Homo sapiens
tgggggtgtcttgaggtcccctccaccgtcgtctccgaatccccctccatgatccttccttgctccatctcaccctggcagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaaaaaaaaaatg

SEQ ID NO: 75252 - DNA, 538 bp, Homo sapiens
agaggtgaggctggagcatatgaggagggggattcagttccaggattagaagcctagactgggagcctaagccgggaagagactggtaaggcctcggtactggaagacgagataaggagaataaaaaaggagtgtaggatggaggagttgggtgtgcgggaaatggaaggagaagtacccaccccctcgtttgcccccagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaaaaaaaaaatg

SEQ ID NO: 75253 - DNA, 1378 bp, Homo sapiens
ggcgcgcgagagccaccgggggggacctggaggagcagcagcacgcggagggaagcccggagccaggactccagcagccccgaccccggaatctttcaccgtccacttcctgccgctcaattctgctcagactctccaccacaagagctgctacaacggccgattccagctcctctatgtggcctgtggtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggatgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaaaaaaaaaatg

SEQ ID NO: 75254 - DNA, 1227 bp, Homo sapiens
  misc_feature (1)..(1): n is a, c, g, or t
ntcgttgggtgactgactctcttgttaaccgcgcacagtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggatgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaaaaaaaaaatg

SEQ ID NO: 75255 - DNA, 898 bp, Homo sapiens
  misc_feature (1)..(1): n is a, c, g, or t
ntcgttgggtgactgactctcttgttaaccgcgcacagtatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacc

SEQ ID NO: 75256 - DNA, 727 bp, Homo sapiens
ggcgcgcgagagccaccgggggggacctggaggagcagcagcacgcggagggaagcccggagccaggactccagcagccccgaccccggaatctttcaccgtccacttcctgccgctcaattctgctcagactctccaccacaagagctgctacaacggccgattccagctcctctatgtggcctgtgggacccagactccagttttgccacccctcctccctcattgtctgggatcccagagccccatcctccctccggatttggagctgaatctcagcctgtcctccgtcctctctgcagttatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggacctgtggctgactaggggctggggtgtctcctcaccagggcctggtcagcacccagatggttcaagtaaagcaagttgtgtccacc

SEQ ID NO: 75257 - DNA, 681 bp, Homo sapiens
ggcgcgcgagagccaccgggggggacctggaggagcagcagcacgcggagggaagcccggagccaggactccagcagccccgaccccggaatctttcaccgtccacttcctgccgctcaattctgctcagactctccaccacaagagctgctacaacggccgattccagctcctctatgtggcctgtgggacccagactccagttttgccacccctcctccctcattgtctgggatcccagagccccatcctccctccggatttggagctgaatctcagcctgtcctccgtcctctctgcagttatggtccatcttctcatccctgagcttggggcctgtgtggcacccggagggaacttgattgtggaattagcccggtacctggtggacgtgcggcaggagcagctgcagggattcaacacccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacc

SEQ ID NO: 75258 - DNA, 700 bp, Homo sapiens
gagtactgctcggggtgggacggggccttggaacagtggagaccaaactggagggtttagaagggcagaggcggttccccacgcctggtctttatcctgaagccccgggtgggctgcgcttccctcccacccctctgcagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaaaaaaaaaatg

SEQ ID NO: 75259 - DNA, 1492 bp, Homo sapiens
ggcgcgcgagagccaccgggggggacctggaggagcagcagcacgcggagggaagcccggagccaggactccagcagccccgaccccggaatctttcaccgtccacttcctgccgctcaattctgctcagactctccaccacaagagctgctacaacggccgattccagctcctctatgtggcctgtgggacccagactccagttttgccacccctcctccctcattgtctgggatcccagagccccatcctccctccggatttggagctgaatctcagcctgtcctccgtcctctctgcagttatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggatgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggagcagcgatgcggctagggaacctcgccctgcaccagccccaatcagacgccgctcctccaactaccgcgcttatgccacggagccgcacgccaagaaaaaatctaagatctccgcctcgagaaaattgcagctgaagactctgctgctgcagattgcaaagcaagagctggagcgagaggcggaggagcggcgcggagagaaggggcgcgctctgagcacccgctgccagccgctggagttggccgggctgggcttcgcggagctgcaggacttgtgccgacagctccacgcccgtgtggacaaggtggatgaagagagatacgacatagaggcaaaagtcaccaagaacatcacggagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaaaaaaaaaatg

SEQ ID NO: 75260 - DNA, 990 bp, Homo sapiens
tcccttctttccccaggacccagactccagttttgccacccctcctccctcattgtctgggatcccagagccccatcctccctccggatttggagctgaatctcagcctgtcctccgtcctctctgcagttatggtccatcttctcatccctgagcttggggcctgtgtggcacccggagggaacttgattgtggaattagcccggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacc

SEQ ID NO: 75261 - DNA, 612 bp, Homo sapiens
ggcgcgcgagagccaccgggggggacctggaggagcagcagcacgcggagggaagcccggagccaggactccagcagccccgaccccggaatctttcaccgtccacttcctgccgctcaattctgctcagactctccaccacaagagctgctacaacggccgattccagctcctctatgtggcctgtgggacccagactccagttttgccacccctcctccctcattgtctgggatcccagagccccatcctccctccggatttggagctgaatctcagcctgtcctccgtcctctctgcagtagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacc

SEQ ID NO: 75262 - DNA, 1117 bp, Homo sapiens
aggctcccgtgggtcaaatccctgtggcttctttatatatttctcaaatggagggtgattatatatgtgatggactaaaccaggacacttttgagaatgaacatgggtgctattggtaatcacaccgagacacagcaacgtccgggaccaactcaaccctcagtccgctcatggggcacaggtttcctggtccttccctaccctgacttctcttcttctgatgtttggtggtctgcatccttttaaaccactgtgctcccagaactgattcccatatgtgtctgccatactggaaaataccaaataggcaaggagatcgtttcaatactgtctgctgaacaccttaatagaggcaagagagaacgcagaggaagaaacaatggactctttctgagagagtggaagatggcttcgcagaggagctgctgtctgagacggatagcatgagtaggagtttccccaggcagggaaggtgttgttgtttctcctcagggtagaggggagagcagggttccccgtgtgtctgttgctgaatgtgactcatgctgttttcctgctttgagcctgctctagggtgttatgggcaggatggacttgtcctgcgtgcttgttgttccgccgtgtttctgatcttcagatttatcgtaaggaagaacagccgatgtacaggcagaacttgacaaatgaggcaacaagcaacttgatctgggatccatcgtcctctagaccccagtaggagtctaagcaccagcgtggtggccaccccagcagccttggacccctgaagccttgagcaccaaagcacacacagcctcctctggctgagttctgtggtcgcctgcaccccctccacctgcttcccccggaggatggatcatgaagagtggaattgcttttcctcttggggcaggcacaccaacagtgtatgtgaggcccctgctcccactccccaggctggccagtactttgggccaatctgctagacccaaaaatgttaatctcactgagatttaatttgcattcccctgactaccggtgaagttgagcatcttttcatatgtttattgacaatttgcatttcttattcagtaaattacctgctcgtatcctagaaaaa

SEQ ID NO: 75263 - DNA, 544 bp, Homo sapiens
cctggctactggtgctataacttgtgtatgctgctctaagggatgaagaaaagacatgacacttaaacaaacccaaaataaatatcaagggcagcacctgggtctttgacatctccctaatggcagaaatcttccctgttgtcaaatttacacactctcataaaccatacattgcacacaccaccaccaccaccacctccgcctccaccacaactgccaccaccattttatccagctcatcattggcagaaaagagggaaatttatggataatttggaaagtaagaaagaatgataggccttattttatcacaatgtaggcatcgtgtttttctgctttggaaatgggaagtatataagttaggaattctttactattacagcaaaaataatgcaagacaaaaatgtaattaagcatgaaaggaatttatgtattagaagactattggatagttctcatcatctctaggaggcccagaagttggaaacctcctcccaaatcctgctgcgaaactgtcccacaaattggcatcaccaccaccgct

SEQ ID NO: 75264 - DNA, 570 bp, Homo sapiens
tggcactccccagtgagatgaacccagtacctcagttggaaatgcaaaaatcacccgtcttctgcatcgctcacgctgggagctgtagactggagctgttcctattcggccatcttggctccactgctgaattcgcatatagtacttttaaatgagaaataaatagccatgaataaacaattctgtcatacaaaagggggaagaaacttttttgtaatttgactttgcagaaaataaaaccccagtgtcagagcctgtcactgtgatctagttctaggaaggtattctgggtttattttccattcttgtctcttggtgaatactgtatttcaaccactatgccttctttgctctctaaatgtaccctgtaatttctgtctctctactctagctcaggggtctctgagctctggatctgtatgtgtatctgtcaatgaacatctatatctggatatcttccaggcacctctggtctaaaacacctaaagcctaactctttaatgtccccatttctactttaatctttatccaggttcctgcgccatcatataactagttgcttaagacaaa

SEQ ID NO: 75265 - DNA, 414 bp, Homo sapiens
aatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggct

SEQ ID NO: 75266 - DNA, 342 bp, Homo sapiens
ctttttccagctgttttcccatgagtgccctctgttccgtcaggtggccgaagacggataactttggcaaagggcttggcacaaatggccaagtttacactggatcactatactccgtgttatcttgtttccccgatggtcattgccacacaagaaagtacttcctctgtgggctttgcccaccctcttctcttgacagagacctctgggcctagataaatgtataaactgcattgcaggaatgaagccgtttccattaagaactggggtctatgtcctgggatccagttcttctcccccttttagtactgaaagctgcttcccatctgaaagctgtctggg

SEQ ID NO: 75267 - DNA, 980 bp, Homo sapiens
  misc_feature (1)..(1): n is a, c, g, or t
  misc_feature (10)..(11): n is a, c, g, or t
ntgaccaagnntgtgcagttctagcaatagaattttgcacaataatgaaggtaaagaatgataaacatctcaagaacatctataaggaggcttatcgcattggtactcttttccacctaaccaaacacaagacagatgaaatggaagataaaatagcagaagtgagaagaaagttcaagggtagagaagaattcctgaaaaaactcactcaaggtgaagtggctgctggaatggtgcttcagaaaaaactatattccatttacgaagtccaggcacttgagcggaaagagcttataaaaaatagagcaatatgtgccatgtcactggcagaactacaggaacctctgcttcaactagaagatgaagctgaaagaatcagaagtctcaacaaagaacattctgttatgcttaataatataattgatcagaaagatcttattagaagaaaggtgggaaaagtaaagaaaaaattacgaaaaaaggggaagaaaacccttgatgcattaatagaaactgagagtaaacgctcagcaatttttaaagacctagaagcaactaaaagtaagacaatgattttttatgcaaaaataaatgaattgaatgaggaattaaaagcaaaagaagaagaaaagaaaagttttgatcagacacttgaaatattaaagaacaaatttataactatgagatttaaaagggaacatgcacaaactgtgtttgatcattatatgcaagagaaaaaagactgtgaagagagaatctttgaggaagatcagagatttagagtgctccttgctgtaagacaaaaaactcttcaagatacccaaaaaataatagctgattcacttgaagaaaatctgcgtttagctcaagagtatcaacagctacagattacattcttaaaagaaaaggacaattatttcaatatatatgataaacagctatcacttgatacttcaattagagataagaaacaggtattg

SEQ ID NO: 75268 - DNA, 431 bp, Homo sapiens
gaaaacctccttaactaagcaacttagtgctactagaaaatagtggtatcctaaaccagatttctaacaagaaaaatgaacaacagtcttttgatcattataaaccaggatcttcagaaaccttgctaggagaagttaatgaaaatagagtatcaatagcattgaaaaaaacctctgaaatccttcacgatattgactgtcttctatcaaactctaaaaagtgaaaaatggaattattacaacatattattaaagtttaaggatgttgtttcaagtgactggtataaaattactagtaagccaagatattgtacgtattaccccggcacaatgattgtgaaagaactgacatttaactttgaaggtatttttaacttgtacatttttaaaatatgtatttatatcttaataataaatatttcgaagttttg

SEQ ID NO: 75269 - DNA, 1076 bp, Homo sapiens
  misc_feature (17)..(17): n is a, c, g, or t
actttctttaagccatnactatcgtatatgctgctggaaaatggtacctgggataaatgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtaaatcaaggtcttaacttaggttggtgtaagttaacttttcctgatggacaagagcagttaattcagattgaacaccctgaaccatatgaaagatatgtgacaacagtaacatcatggtgcaggagactgacccagactagtcccagagagatgcccactcattcgtcatcttctgttctccaagaaaattggtctgttgcttctgaacttgaaaagatacagaagtttaacttgctactagaaaatagtggtatcctaaaccagatttctaacaagaaaaatgaacaacagtcttttgatcattataaaccaggatcttcagaaaccttgctaggagaagttaatgaaaatagagtatcaatagcattgaaaaaaacctctgaaatccttcacgatattgactgtcttctatcaaactctaaaaagtgaaaaatggaattattacaacatattattaaagtttaaggatgttgtttcaagtgactggtataaaattactagtaagccaagatattgtacgtattaccccggcacaatgattgtgaaagaactgacatttaactttgaaggtatttttaacttgtacatttttaaaatatgtatttatatcttaataataaatatttcgaagttttgcaaaaaaaacacaaaaaaaaaaaaaaaaaaaaaaaaagagaggccgagcacaaacataagagagtatacccagagggggccaccaaattaggggcacaccccacttgcgttcacacagtgggcccacaagggggagcccatttaaacgccagacatggccgcacgtacacgcccccccccccggcgcaccaggccccccccgcgccccctcggcgggacgcat

SEQ ID NO: 75270 - DNA, 853 bp, Homo sapiens
  misc_feature (17)..(17): n is a, c, g, or t
actttctttaagccatnactatcgtatatgctgctggaaaatggtacctgggataaatgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtaaatcaaggtcttaacttaggttggtgtaagttaacttttcctgatggacaagagcagttaattcagattgaacaccctgaaccatatgaaagatatgtgacaacagtaacatcatggtgcaggagactgacccagactagtcccagagagatgcccactcattcgtcatcttctgttctccaagaaaattggtctgttgcttctgaacttgaaaagatacagaagtttaacttgctactagaaaatagtggtatcctaaaccagatttctaacaagaaaaatgaacaacagtcttttgatcattataaaccaggatcttcagaaaccttgctaggagaagttaatgaaaatagagtatcaatagcattgaaaaaaacctctgaaatccttcacgatattgactgtcttctatcaaactctaaaaagtgaaaaatggaattattacaacatattattaaagtttaaggatgttgtttcaagtgactggtataaaattactagtaagccaagatattgtacgtattaccccggcacaatgattgtgaaagaactgacatttaactttgaaggtatttttaacttgtacatttttaaaatatgtatttatatcttaataataaatatttcgaagttttg

SEQ ID NO: 75271 - DNA, 440 bp, Homo sapiens
tttaacttaactaagcaatacttttgcatggttccaaattcaaattgtgcacagtggaatagacaatgaccagccttcctcccacctcttttctctggccaccacattttctttcctggaggaaataggtgttatctgattctttttcatctttccagagatatattatgcaatcaaaagcataatgaagctatttttgctgtctaaaaatattttcagttttttgggggtaaaaattaatatattaatatgttctagtattcttctgatatttgcagtgactgtatttgtcccagtaatgtggttcctctctttatttctgtaggtaaattgctagaatgagatgttggactgttttttaaaattaaaaatacatgaaagaacatagtggccagatttagcaagtatgaataaagaataccaagtggaatttgaattga

SEQ ID NO: 75272 - DNA, 1097 bp, Homo sapiens
tgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatct

SEQ ID NO: 75273 - DNA, 409 bp, Homo sapiens
gcgatacagattgcctctgttgccaggagaaaacattcccacagcagtgtgaaaaaagaaaagttaattcaggccagggtgggaacagcagagacggggatgcacaagaatgaggggagacaggacagactgagtccaggatgataatacttgccctgtcggcctcatggggtttgagggagtctgtaacgcatcccacagacacaagcgagaaagtggatgggagactctccacggccaagttgaggcatgagtcagctccgtgttccctggagcagctataattggccctgtcgaaagcaccctcagccatgtgatgaagggattccagcacgaaggagaatctggtggccagacagtccagcctccttgcgacaggccagcccgcccagggcactacccggcaccg

SEQ ID NO: 75274 - DNA, 260 bp, Homo sapiens
taagggcataatagttaccagcattagagtatccatggtggaatttactaaatatttaaaaaattcttaagatttagtgaagaccaggtcagggaaaggagagcgcagcctgacctggcaggagcgcaccctggaggctttgctgtcagtctccatgcctggctttcagcaaagtgctccttccaagaaaggctttgagctccctccagaggttggtaatagtacacattttgaatgaaaaaatcttgacagttacagtg

SEQ ID NO: 75275 - DNA, 564 bp, Homo sapiens
cggggcatgacgggcacctcggctggcacgtactccaccctccggggctcggggcctgaggagcagaaggtggccctgggcagatgctctgcgtgcgggaggctgcgctttcagtcattatttggatttcgttttccacatgaaaatatttagagatccagctcttggaagccaaggagaaactggcttttaagtaccatggctactgtgacgtatcctgactaatgccgacagcacagggagcctttgcctgccggaggaagcggtgaggaagaggtggtgcgtcgtgcacttcctgttgctgttttaggacagcttggacgtagtttgttccagggaagtgctgctgaaccaggtaaacccagcccccccatctccaggagcagaggctgcaaggacaggaagacaatgaggcaatggtgtgctgggggaatcgtgctaaagtgaaagcatccttcgatcatttttaagtcattctaggatcttcagggcatcaaagttttgcctgtgagcctcaattggtctaatacaaaaatacagactgtggttaatcatctgagcttt

SEQ ID NO: 75276 - DNA, 2008 bp, Homo sapiens
tgaggaaacgtgtgacaagatactcctagagaacagctcttaattttctgcaggttctttttgagaaactggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaac

SEQ ID NO: 75277 - DNA, 2512 bp, Homo sapiens
tagcaattaccttactaaagaaacattttttaaggatagaaatagtgtattaaagcacccagcacggcctttgaaatcataaatagtggctacagaggtggttataattatggccatatgacaagaatgacagaaaattgcctcaaaaccaaacagtgacaatgacagaacccaggctccctcaggccctccttcctcagctccctctgtgggagtaggtgcattcctgggcaatcttccctccatctctacctcagctgttcccaaactctcgaagtttgttctgggaggtgttaaaagcagttttctaagacaaagggtcccaaggagaagcctcatttcacattagcatattaaaggatctgataaatcctgcagatgggagacttattttgtttaaccctcggttccccagatgtgttgaaacccgaaaccctcttggctgaggtctggctaacctcttgcagagctattgcctcaaagtacacagttgtggaaccccgcccaaaccttcacctacccagactgctgagtagctcatttggactctcagagtccaaagctgctcacatttccagtccccgagggtcttgttctgtccagcccaggccaagagggaagctgtgcatctgcccggtgcagccttacacagcagtccaggcaggggcaccccacacccacacacccctgacatcaccctggccgcgggttcaaggcaactgacatctctcctggatcccgaaaagcaggaggtgggaggtctgacctgggccctctgcttggctgtttccccagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaac

SEQ ID NO: 75278 - DNA, 2143 bp, Homo sapiens
aaggcgcgggccccggcgcggcggggagggctcggccggaggggaggctgcggcgcgcggccggtcgctgcgggcccgggccccaagccgtgccgctccgctcgcccgggcccagccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcaggtaaccctgcaaggggaaggggcagcaggagagactgaggctagacaccaggaagaactggaaagaccggcagcagtgagcgaagggagcacatggccttagggaagcctccccttggaagttaagtagaatttgagagaggtactctccaggctccgagaccataccctgaatgaaagggaaactagtacagacacaggaagcgctttgcatgtacctggtactcttccgcacttgacacaacatcactgaacctcaccacacagatgaggaaactgaggctcagagattacttggccaaggtcccttgagaggggcacagagtaaaggatcctc

SEQ ID NO: 75279 - DNA, 3524 bp, Homo sapiens
aaggcgcgggccccggcgcggcggggagggctcggccggaggggaggctgcggcgcgcggccggtcgctgcgggcccgggccccaagccgtgccgctccgctcgcccgggcccagccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactgaccccatctcctgccgccgccctggggccgccgcagggatgccttgccttttcaggatttgagactgttctcaaagggattgggaacgaaggccccatctcgggcagacccccagcagatgtgtcggacaagcaacttcttttcctctgtgaggagacaagacttggagactcagcgatgtcaggccagggccatggccacactggcccacacattcctttctacagagaatttctatgaagcccactcacttgccattccagggccaaaggaccggaggtttgcatatccgccccttgtatttgatttgcttccttttggtttcttggtttttgtttttgcttgattttgtcttttctctacagtttagttttgtcacaattacacatatagttttcaaaatcatgcactttctaaaatggtgtcatcctgaaaaacaaaacccagtgtttgcacacacacaaaatcttgaccccgttatctatattttaaatgctttttgcccaacactgaccctatgttcaactttgtgtcatttaccttataatttgaggaggggtttccctttgggcctcagtgttacaaattactagtgctattttcattattattgtaatggaaaaatctgtggactagaataaaagagtttattgaataagaaatatgattgggctcattgcacatcagtgactcctagaaaaaccattgcaatgttaccatcagaaataataatcagccagcagttgatttaaggtataatttagtaaacgattccaacttctattacctcccctgaaatcggtcctgatatattcgagaagcatgaggccagcccttcagatgcagttgtttatttatactcaggtttagattgggaagaggcccagggaggagcagcaacttgcctgaggtcacacagcccaaaaaaggcaaaggagagtctcgcccctgccgtctcctggccaccccagttgagtgtccgtctgttccatcattcagcagatgcttggtgagtgcctgcaacggaccagacactgggctagaggccagggacaccgctgagagtgagacagtcataagccctgcagtcaaggggtcaagaggggagaaagcgatggtaagggaaactgacaagtaagtgaagtgactgcaggtcataggaaatgctacaaaggagatagatagacagctgaggacctaccctacggggtcagggagggcctctctgggcaggtgaccttcaagccaagacccagaagataaaaaggagcagccgaaagactatctggcagaagaatgaac

SEQ ID NO: 75280 - DNA, 2053 bp, Homo sapiens
aaggcgcgggccccggcgcggcggggagggctcggccggaggggaggctgcggcgcgcggccggtcgctgcgggcccgggccccaagccgtgccgctccgctcgcccgggcccagccgaggccgctgcgcccccgcctcctcgcgggaggactcgctccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgatgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcaggtaaccctgcaaggggaaggggcagcaggagagactgaggctagacaccaggaagaactggaaagaccggcagcagtgagcgaagggagcacatggccttagggaagcctccccttggaagttaagtagaatttgagagaggtactctccaggctccgagagggaagagggaagacatggaggaccagatcatggaagatctaacatgtctcagttgacatctcagactcaacatacataccctct

SEQ ID NO: 75281 - DNA, 1918 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75282 - DNA, 1874 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcg

SEQ ID NO: 75283 - DNA, 1052 bp, Homo sapiens
  misc_feature (811)..(812): n is a, c, g, or t
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagcgaagcaaggcgagaagcagcgcagggctataaaccaggaactcacaagtaatgccannagcagccgcgcactcccactaaccaccgaggattagaggaccagcaggccgctggccccggactccactcatagatcacctaacaaccaggggggtggggagggaggaaggagaaagaccaagcaggaaagcaacgcacaggaagggaagagcaggagcaagcacacaaccaggacaaaagccgacaagagagaagagcgaggacaaaaaacaagagagcctcagagagacacaaccacc

SEQ ID NO: 75284 - DNA, 980 bp, Homo sapiens
  misc_feature (763)..(764): n is a, c, g, or t
tagctagtagctgggtaatcggcgagggtatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacganncagcgcgccatcctattaccaccggagagaagagaaccagaggcccctgctcccggctcgcacctaagttgaactaccctccacgggcgggtgggctgggagggaggagactggaccccaagggggaaaggaacagaaaggagggaaaggcgcaggaaagggccctaaaaggcacagagagaagcacatgcagacagagggggaccaagggcgaga

SEQ ID NO: 75285 - DNA, 901 bp, Homo sapiens
cggacgcgtgggtcgacccacgcgtctctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagtctatcgcaggaccgacccatgatggacgggggcaatgggaatacgtgcaggccacgaagaaacagaccatagccttgaggccatgggaacacacagggtcaaggggcccagagggtacccctacagtacctggaagccgaaagccaagagcagcagaaggcagaggcagagagacctaattacaacccaaggacaatcctccaagaagggtacgagcgtagccaacgaggcaaggcgccgcagaccaccctaagtagcccagcgggaaggataagaaagaccacagtaaggcccaccagggctcactggactcga

SEQ ID NO: 75286 - DNA, 1873 bp, Homo sapiens
  misc_feature (26)..(26): n is a, c, g, or t
gtgctaggtagcgaggctgggtgtgnggtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75287 - DNA, 1879 bp, Homo sapiens
  misc_feature (30)..(30): n is a, c, g, or t
ctaggctaagtagaggctgggttaatcggnagagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75288 - DNA, 1871 bp, Homo sapiens
cggacgcgtgggtcgacccacgcgtctctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75289 - DNA, 1865 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75290 - DNA, 1573 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcg

SEQ ID NO: 75291 - DNA, 1862 bp, Homo sapiens
actagtggatccgtcgacggccattatggatggatggggagtatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75292 - DNA, 1864 bp, Homo sapiens
gagataggcagaagagggccgggggttgaatcggcacggaggctatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75293 - DNA, 1049 bp, Homo sapiens
  misc_feature (832)..(833): n is a, c, g, or t
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacganncagcgcgccatcctattaccaccggagagaagagaaccagaggcccctgctcccggctcgcacctaagttgaactaccctccacgggcgggtgggctgggagggaggagactggaccccaagggggaaaggaacagaaaggagggaaaggcgcaggaaagggccctaaaaggcacagagagaagcacatgcagacagagggggaccaagggcgaga

SEQ ID NO: 75294 - DNA, 1856 bp, Homo sapiens
catcagctaggtcgaggccctgcggtgatcggccgtatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75295 - DNA, 792 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaagccggaggttgaatgccattcacgctgtc

SEQ ID NO: 75296 - DNA, 2103 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctggtgagtgtgtcctttgctgcccccactcccctcatgagcccacctacccaggctccccccaggccagggagactttattccttgagctgcttcaggaccaacgaaggagctggagaggcccccctcacccgggagggggccgcagccgggtgctcaccatgtccttgttactctctcaccgagcaagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75297 - DNA, 1783 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75298 - DNA, 1930 bp, Homo sapiens
cggacgcgtgggtcgacccacgcgtctctcgggacccctgttggagagactatggcgctcaacaagaatcactcggagggcggcggagtgatcgtcaataacaccgagaggtgaaaacactgcggaaggatcctggaggaccaaagttcgggtgtcgaggaagtgggcgcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75299 - DNA, 1926 bp, Homo sapiens
gcttgaaaaacaaaccagcaaaaacagaacatctatcacaaggacttaaaagaaaatagaagagttggccgggcgcagtggctcacgcctgtaatccctgcactttgggaggccgaggcaggtggatcacgaagtcaggagatcgagaccatcctggctaacacgcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75300 - DNA, 1696 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75301 - DNA, 1804 bp, Homo sapiens
tgtggacgtaagacaaacacgtgctcgtcctttaatggagttcaccagcacacttgttaaccagtcctgtttgctttcgtctttttttgtgcgtaataaagtcaactgaccaagtgtccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75302 - DNA, 1553 bp, Homo sapiens
atagaagatccccgaacgggtgatgcggttgcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75303 - DNA, 948 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagtctatcgcaggaccgacccatgatggacgggggcaatgggaatacgtgcaggccacgaagaaacagaccatagccttgaggccatgggaacacacagggtcaaggggcccagagggtacccctacagtacctggaagccgaaagccaagagcagcagaaggcagaggcagagagacctaattacaacccaaggacaatcctccaagaagggtacgagcgtagccaacgaggcaaggcgccgcagaccaccctaagtagcccagcgggaaggataagaaagaccacagtaaggcccaccagggctcactggactcga

SEQ ID NO: 75304 - DNA, 1620 bp, Homo sapiens
cccgatgtcgcacagagagcctcagaatggccagagactgctgagagccgcagatgatggatgacccctggactaccccaggggcccagcagggctgtggcctggtggagcggagctagattctggccccacccccatcccttagctatccatgtgccctgggcggggaaggtcaccctgtgtgcctctcgatcctctcatctacactcagctggtcggtcacagtggcacctggggcattggctcaaggattagatgaggtgagacatgcgatgggcctggaaaggaccgtgccagcgcgtggcatgtgctcaggaaacctcacctgctgctctcattggtggaactggacccccagcaccagctgccccgagccatgggggcccggggtctcttagctgagctcagggtggaggagaacttgtcaccgacaccaggtgtgtttgctctcacagccgaagccaaggccgcagaagcagccgccagcgcctattacaacccaggcaatcctcacaacgtctacatgcccacgagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcgatttgtttgctgaaaatgtgaaatagtaaaaatgaaataactgg

SEQ ID NO: 75305 - DNA, 652 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctgggtagccgtatgcaggcccgggcggcatgatgcagagcgatgataagga

SEQ ID NO: 75306 - DNA, 1067 bp, Homo sapiens
tccgctaccataatcatcgctatagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcg

SEQ ID NO: 75307 - DNA, 991 bp, Homo sapiens
cggacgcgtgggtcgacccacgcgtccctcatctctctaccctacccctcccatcggggctgtgctggggcttggggaggggagggggcgccttgttctccctccaggtctgatcataaacaattaccaggaactagcattgtgggacattagggcccccggcctcgggagaggtgccgcccagcttcccatgccagcccggagcccacagtgctgcccagcgtacctccctcaccgtctggggctcttctgggagcacggagcatcccctgttcctgtttcactctcagcttctcccctcgaagggactctctggccacctcctccaccgcagtccagctccctcagtctggcacccactgctacactcagcctcatgagccacttcagaccagccaggtgtcttcccgggccctgccagaccctgctcacattccctctgctggtctgtgctggtctcagaaggccaccgcgcccgcattccactcagccagggtccagctgcagcccccgccacccttccttcccttccctgtcctgggtcatgttgttgccaccctgtgtgacttttgaagctgtaaaatgagcttccagggcttgggtggcgtcggggcagggccgccgaggctgggaggaagcccttctgccttttgctggtgtttctggaatttgctttccctcacctctcacttccttctagaaggagcttcctgactggaaccagagaatgcatgtctgtccacttggtggctgctgggtggggccgggaacaagggcccctgaccctgtgtgctggccgggacctgccaccagccccccagcctgcttcttccccttaagctttgtgcccctggatgcgctaacattcactcttgtttgtccctggactggccatgaagtgaggagatggttatttaaagagaattccctatttatttgacaaaaaatccagttaatatattaatgtgaaataaaccctgtttgcacctcg

SEQ ID NO: 75308 - DNA, 880 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaaggtatccaggctccgaagattaggggctaaagacacactaaacatgtaggggtttggtatgagtttgcttccttttcgttttgctttttcaagaactcaagaggtaagtgtttgggcaccaggctgaccaggcctaggagttgggaaggaaagctgtcattggcatcagctctgtcctgtacctcagagactgcgtttccctgcctggggcaggtggatgacgttttgacaaagctgtttggactcaaggacactttactatggcctcataaaacaaacactaaaccaaccattcgactgcggttccgcagccattgaaaatgaccgagggatgggccagcagacatcctccgccagctcactcctaccccagccctgagcctccc

SEQ ID NO: 75309 - DNA, 934 bp, Homo sapiens
gattggctgactctaataagaagacgccactaggggcggggcgaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtaggtgatgggaactcagggacacgcatggggcctgcagggaggtgtcctgggaacctctgactgccgccgtgggggcgtccccttcagacccttatcgccctagccatgacctcttcccagctctgggctgccagctggtggggtttgattgccaagaggtggggaaaatgctggcatgaaagacagcagctcagatcagcttttcagagcgtgaagtctgcagaagcctgcggactgagtcaagatgcttagtgcaacttggcgagcgcatacaaattttagactcaggaaggagctgcatcaggttcttgagaggggccttttcatgagagccaggaagaggcagctgcctctgggaagccagagtcaccctgctttggggctggctttttggcaggccccagagacctctgcattgaacttgccttccccttgacacccagccaggcccgcccttgctattgagacactcttggtccccctttgggcagaagccaggctagaggggccggagtctgtccttgggccc

SEQ ID NO: 75310 - DNA, 729 bp, Homo sapiens
gagataggcagaagagggccgggggttgaatcggcacggaggctatggcgctcaacaagaatcactcggagggcggcggagtgatcgtcaataacaccgagaggtgaaaacactgcggaaggatcctggaggaccaaagttcgggtgtcgaggaagtgggcggtgggtggtgggtggtggggaataagcccctgaagagggagcactgatggagtgaggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggctactcttacatgcccagcggggcctatgtctatcccccgccagtcgccaatggaatgtacccctgccctcctggctacccctatccaccggccccacctgagttctatccaggaccccccatgatggacggggccatgggatacgtgcagcccccaccaccgccctaccctgggcccatggaacctccggtcagcggccccgatgtcccctccactcctgcaggtgagggcccttgggtgctggcag

SEQ ID NO: 75311 - DNA, 425 bp, Homo sapiens
tggaggagaacttgtcaccgacaccaggtgtgtttgctctcacagccgaagccaaggccgcagaagcagccgccagcgcctattacaacccaggcaatcctcacaacgtctacatgcccacggtgagagggcttggcagtgccggtgcagccccacagccgcagatgctgggagccgcagggggatgaccgcaccatgttttaaaccttctaatgcaagtctctcctttctcccttctttagagccagccgccgccacctccctactacccaccggaagataagaagacccagtaggccctcctgcctccctgcctcccaccctcatctctctaccctacccctcccatcggggctgtgctggggcttggggaggggagggggcgccttgttctccctccaggtctgatcataaacaattaccag

SEQ ID NO: 75312 - DNA, 1101 bp, Homo sapiens
  misc_feature (13)..(13): n is a, c, g, or t
  misc_feature (18)..(18): n is a, c, g, or t
aattcgcggccgntacgnacacggctgcgagaagacgacggggagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaa

SEQ ID NO: 75313 - DNA, 1495 bp, Homo sapiens
gacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactataaaaaaaaaaaaaaaaaaaaaaaaaaaaaaaaaaaaaaaaaaaaatgttttttaaaaggggaggagggggggaaaaaaaattccggggggggccaaagttagggggaacggttttttggtgaaaaaggggggccaaataggggggagggtatattaaaaacaagagacggggggccgagatttaaacaacgcggtgggaggggacaacaggtggcagctggggaaatctggtgggaaagggaacccaatgtcgggggggagacataggggaaataaccaagagattaaggtcgggggcaatataaaattgagggttcagtggtcacacacgaatgtgcgccggaaattggcgcggaataatggaactttccgagggagtaa

SEQ ID NO: 75314 - DNA, 1172 bp, Homo sapiens
gacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttcgcccccgccgcccgccggcccccccccccccccgcgcccccgctcccaccgcccgccgcctcccccaaccgccgcgcccccgccccccggcgccccaccgccccccccccgcgggctaaattatatgaactactatacattatgtatattaattaaggcatcttaatccagaacaacaccagggggaaaaa

SEQ ID NO: 75315 - DNA, 947 bp, Homo sapiens
agctcggtaccgattacgctcctagacggggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaa

SEQ ID NO: 75316 - DNA, 940 bp, Homo sapiens
  misc_feature (13)..(13): n is a, c, g, or t
  misc_feature (18)..(18): n is a, c, g, or t
aattcgcggccgntacgnacacggctgcgagaagacgacggggagtgcagagctgctgtcatggcggccgctctgtggggcttctttcccgtcctgctgctgctgctgctatcgggggatgtccagagctcggaggacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaa

SEQ ID NO: 75317 - DNA, 1100 bp, Homo sapiens
  misc_feature (113)..(113): n is a, c, g, or t
  misc_feature (122)..(122): n is a, c, g, or t
  misc_feature (140)..(140): n is a, c, g, or t
  misc_feature (182)..(182): n is a, c, g, or t
tgggggctttcttttccccgtcccttgcctgcttgcctgctggctaattcggggggatggtcccaagagccttcgggaagggtggccccccgggggcttggcttggcttgaangggaatccngggaaggggaaggtgggnggtccgggcattagggaagatccgcctttcaaggaattgaangggccggtgccagtttggtcccaaggggtggaagcccttaagaactgggatctcggccggccccgagttgccttggtaagacgggagaaagagccacgtcgggtttccttaaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaa

SEQ ID NO: 75318 - DNA, 1032 bp, Homo sapiens
gacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaaagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaa

SEQ ID NO: 75319 - DNA, 501 bp, Homo sapiens
gacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaacatggtaccaggtgtaatctccctgaactggctatgtgcaagaagacttccttcagagatttcaggcttcctccaaggaatctgcaatgcatatagacacttatggattttctcctcaatacctgtgagagaaatactgtaattttgttttata

SEQ ID NO: 75320 - DNA, 1152 bp, Homo sapiens
gacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaa

SEQ ID NO: 75321 - DNA, 1532 bp, Homo sapiens
gacagaaacgggcgcgcagtgatgacaacatcaagccgccagcggcggcggtggcggccgggagactgggagggcttccggggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacagatgggagttttgtggttcatgatataccttctggatcttatgtagtggaagttgtatctccagcttacagatttgatcccgttcgagtggatatcacttcgaaaggaaaaatgagagcaagatatgtgaattacatcaaaacatcagaggttgtcagactgccctatcctctccaaatgaaatcttcaggtccaccttcttactttattaaaagggaatcgtggggctggacagactttctaatgaacccaatggttatgatgatggttcttcctttattgatatttgtgcttctgcctaaagtggtcaacacaagtgatcctgacatgagacgggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaaaaaaaaaaaaaaaaaaaaaaaaaaaaaaaaaaaaaaaaaaaaaatgttttttaaaaggggaggagggggggaaaaaaaattccggggggggccaaagttagggggaacggttttttggtgaaaaaggggggccaaataggggggagggtatattaaaaacaagagacggggggccgagatttaaacaacgcggtgggaggggacaacaggtggcagctggggaaatctggtgggaaagggaacccaatgtcgggggggagacataggggaaataaccaagagattaaggtcgggggcaatataaaattgagggttcagtggtcacacacgaatgtgcgccggaaattggcgcggaataatggaactttccgagggagtaa

SEQ ID NO: 75322 - DNA, 436 bp, Homo sapiens
  misc_feature (14)..(14): n is a, c, g, or t
cccccgggctgcangaattggcacgaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagtagcactggatcgtctgtgctgtgcctttt

SEQ ID NO: 75323 - DNA, 3528 bp, Homo sapiens
  misc_feature (46)..(46): n is a, c, g, or t
  misc_feature (187)..(187): n is a, c, g, or t
agcgggggggagggggcggaccccgagccgcgaggggcgcggggcngggcgcggggtcccgggagagggcgctgggcgcttcgggcccagatcatctttcttgctgacaagtatcatctaggaatcactctacctcgctggcaattttgagaaaatagccagttattttgtgctgaactttcatctngttaagggtcattccttcagtattcaagacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75324 - DNA, 3649 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75325 - DNA, 3662 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75326 - DNA, 3662 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggctgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75327 - DNA, 2588 bp, Homo sapiens
ggcgacccgggcgcctgggtgtgtggctgctgttgcgggcctccccttcctcatcatcgagacaagcaccatcaagccttaccaccgagggttttactgcaatgatgagagcatcaagtacccactggccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga

SEQ ID NO: 75328 - DNA, 3133 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtctccgggtacataactcgagtcgtatcatgta

SEQ ID NO: 75329 - DNA, 3107 bp, Homo sapiens
tttccttaaaaattatattttcagggtaatacaattcaagtcacaataaagacctgaaagcctcaggtttgtaggtgaggaaaaatgcattttagctgtacagccctaacttttacttgacccaaggccagcaagaaaatgtttctttttatttatatatattttttctttggtgacaatttggtgtttctgaacgctaggggctcccggtttctctggtttgagagtaacttttccttttaggacttttttttttttttttgaagggggtgggggaaaatgtggccttaattatcctacgtcttaggcagcttaaggaaggggctgtgctttcggaatcccatccgagccaagtaaggaggtccctctctctctctccccccacgtcttctctttttaaaggacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgacttcagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccgggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagttttcctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaattaaggacttgcaaactgga
